United States Patent
Reinders et al.

(10) Patent No.: US 12,543,674 B2
(45) Date of Patent: *Feb. 10, 2026

(54) EMBRYOGENESIS FACTORS FOR CELLULAR REPROGRAMMING OF A PLANT CELL

(71) Applicant: PIONEER HI-BRED INTERNATIONAL, INC., Johnston, IA (US)

(72) Inventors: Jon Aaron Tucker Reinders, Clive, IA (US); Huaxun Ye, Johnston, IA (US)

(73) Assignee: PIONEER HI-BRED INTERNATIONAL, INC., Johnston, IA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/594,386

(22) PCT Filed: Apr. 17, 2020

(86) PCT No.: PCT/US2020/028815
§ 371 (c)(1),
(2) Date: Oct. 14, 2021

(87) PCT Pub. No.: WO2020/214986
PCT Pub. Date: Oct. 22, 2020

(65) Prior Publication Data
US 2022/0240467 A1  Aug. 4, 2022

Related U.S. Application Data

(60) Provisional application No. 62/947,786, filed on Dec. 13, 2019, provisional application No. 62/835,500, filed on Apr. 18, 2019.

(51) Int. Cl.
| | | |
|---|---|---|
| *A01H 4/00* | (2006.01) | |
| *A01H 1/02* | (2006.01) | |
| *A01H 5/08* | (2018.01) | |
| *C12N 15/82* | (2006.01) | |

(52) U.S. Cl.
CPC ............ *A01H 4/008* (2013.01); *A01H 1/022* (2021.01); *A01H 1/026* (2021.01); *A01H 5/08* (2013.01); *C12N 15/823* (2013.01); *C12N 15/8233* (2013.01); *C12N 15/8261* (2013.01)

(58) Field of Classification Search
CPC ............................... A01H 1/022; A01H 4/008
See application file for complete search history.

(56) References Cited

U.S. PATENT DOCUMENTS

| | | |
|---|---|---|
| 4,959,317 A | 9/1990 | Sauer |
| 5,573,932 A | 11/1996 | Ellis et al. |
| 6,399,855 B1 | 6/2002 | Beavis |
| 6,800,791 B1 | 10/2004 | Bailey et al. |
| 7,230,089 B1 | 6/2007 | Roberts et al. |
| 7,572,635 B2 | 8/2009 | Armstrong et al. |
| 7,579,529 B2 | 8/2009 | Gordon-Kamm et al. |
| 8,030,560 B2 | 10/2011 | Zhao et al. |
| 8,039,686 B2 | 10/2011 | Podlich et al. |
| 8,321,147 B2 | 11/2012 | Bink et al. |
| 8,334,429 B2 | 12/2012 | Ranch et al. |
| 8,574,910 B2 | 11/2013 | Falco et al. |
| 8,581,036 B2 | 11/2013 | Samboju et al. |
| 8,859,846 B2 | 10/2014 | Barton et al. |
| 8,865,971 B2 * | 10/2014 | Zhao .................... C12N 15/829 800/278 |
| 9,040,774 B2 | 5/2015 | Ivashuta et al. |
| 9,121,032 B2 | 9/2015 | Williams et al. |
| 10,031,116 B2 | 7/2018 | Geha et al. |
| 10,102,476 B2 | 10/2018 | Caraviello et al. |

(Continued)

FOREIGN PATENT DOCUMENTS

| | | |
|---|---|---|
| CN | 104031936 A | 9/2014 |
| JP | 2017155715 A | 9/2017 |
| WO | 9842851 A1 | 10/1998 |
| WO | 0017364 A2 | 3/2000 |
| WO | 02085104 A2 | 10/2002 |
| WO | 2005063990 A2 | 7/2005 |
| WO | 2005/075655 A2 | 8/2005 |
| WO | 2006116876 A1 | 11/2006 |
| WO | 2006/128707 A1 | 12/2006 |
| WO | 2011082318 A2 | 7/2011 |
| WO | 2012142311 A1 | 10/2012 |
| WO | 2014091255 A1 | 6/2014 |

(Continued)

OTHER PUBLICATIONS

Xu et al., 2014, Cas9-based tools for targeted genome editing and transcriptional control. Applied and environmental microbiology, 80(5), 1544-1552. (Year: 2014).*

(Continued)

*Primary Examiner* — David H Kruse
*Assistant Examiner* — Santosh Sharma

(57) ABSTRACT

Plant cell fate and development is altered by treating cells with cellular reprogramming factors. Embryogenesis inducing embryogenesis factor genes and/or morphogenic developmental genes are used as cellular reprogramming factors, specifically comprising polypeptides or polynucleotides encoding gene products for generating doubled haploids or haploid plants from gametes. Maize microspores treated by contacting the isolated cells with an exogenous purified, recombinant embryogenesis inducing embryogenesis factor gene products and/or morphogenic developmental gene polypeptide results in embryogenesis. The gametes of a maize plant develop into embryoids when transformed with a genetic construct including regulatory elements and structural genes capable of acting in a cascading fashion to alter cellular fate of plant cells. Embryogenesis factor proteins and/or developmental morphogenic proteins expressed from a genetic construct are used for ex situ treatment methods and for in planta cellular reprogramming.

9 Claims, 8 Drawing Sheets

Specification includes a Sequence Listing.

(56) References Cited

U.S. PATENT DOCUMENTS

| | | | |
|---|---|---|---|
| 10,280,472 B2 | 5/2019 | Arnold et al. |
| 10,285,348 B2 | 5/2019 | Kelliher et al. |
| 10,640,779 B2 | 5/2020 | Cogan et al. |
| 11,193,131 B2 | 12/2021 | Campbell et al. |
| 11,330,776 B2 | 5/2022 | Anand et al. |
| 11,401,524 B2 | 8/2022 | Armstrong et al. |
| 11,447,786 B2 | 9/2022 | Fox et al. |
| 11,732,269 B2 | 8/2023 | Kerstetter et al. |
| 2002/0023278 A1 | 2/2002 | Lyznik et al. |
| 2002/0188965 A1 | 12/2002 | Zhao et al. |
| 2005/0148765 A1 | 7/2005 | Cahoon et al. |
| 2005/0257289 A1 | 11/2005 | Gordon-Kamm et al. |
| 2005/0289673 A1 | 12/2005 | Armstrong et al. |
| 2007/0271628 A1 | 11/2007 | Lowe et al. |
| 2010/0010056 A1 | 1/2010 | Rehan et al. |
| 2013/0198893 A1 | 8/2013 | Zhao et al. |
| 2014/0359836 A1 | 12/2014 | Wu et al. |
| 2014/0359897 A1 | 12/2014 | Kelliher et al. |
| 2015/0121561 A1 | 4/2015 | Koivu |
| 2015/0152430 A1 | 6/2015 | Albertsen et al. |
| 2015/0247154 A1 | 9/2015 | Ivashuta et al. |
| 2016/0212956 A1 | 7/2016 | Boutilier et al. |
| 2016/0304901 A1 | 10/2016 | Ozias-Akins et al. |
| 2016/0321396 A1 | 11/2016 | Habier |
| 2017/0183677 A1 | 6/2017 | Gao et al. |
| 2017/0245446 A1 | 8/2017 | Cooper et al. |
| 2017/0359978 A1 | 12/2017 | Technow et al. |
| 2018/0094273 A1 | 4/2018 | Kumar et al. |
| 2018/0216123 A1 | 8/2018 | Anand et al. |
| 2018/0245090 A1 | 8/2018 | Campbell et al. |
| 2018/0265877 A1 | 9/2018 | Anand et al. |
| 2018/0363069 A1 | 12/2018 | Bakiwala et al. |
| 2020/0263189 A1 | 8/2020 | Fox et al. |
| 2021/0010012 A1 | 1/2021 | Gasior et al. |
| 2022/0056461 A1 | 2/2022 | Kong |
| 2022/0154203 A1 | 5/2022 | Gordon-Kamm et al. |
| 2023/0189734 A1 | 6/2023 | Reinders et al. |
| 2023/0203516 A1 | 6/2023 | Fox et al. |

FOREIGN PATENT DOCUMENTS

| | | | | |
|---|---|---|---|---|
| WO | 2015/061355 A1 | 4/2015 | | |
| WO | 2015048016 A2 | 4/2015 | | |
| WO | 2015167956 A1 | 11/2015 | | |
| WO | 2016/146552 A1 | 9/2016 | | |
| WO | 2016149352 A1 | 9/2016 | | |
| WO | 2017004375 A1 | 1/2017 | | |
| WO | 2017017108 A1 | 2/2017 | | |
| WO | 2017070032 A1 | 4/2017 | | |
| WO | 2017078836 A1 | 5/2017 | | |
| WO | 2017/153766 A1 | 9/2017 | | |
| WO | 2017155715 A1 | 9/2017 | | |
| WO | 2018015956 A1 | 1/2018 | | |
| WO | 2018015957 A1 | 1/2018 | | |
| WO | WO-2018098420 A1 * | 5/2018 | ........... | C07K 14/415 |
| WO | 2018183878 A1 | 10/2018 | | |
| WO | 2019075295 A1 | 4/2019 | | |
| WO | 2019/122381 A2 | 6/2019 | | |
| WO | 2019/177976 A1 | 9/2019 | | |
| WO | 2019185849 A1 | 10/2019 | | |
| WO | 2020/185751 A1 | 9/2020 | | |

OTHER PUBLICATIONS

Gordon-Kamm et al., 2019, Using morphogenic genes to improve recovery and regeneration of transgenic plants. Plants, 8(2), 38, (Year: 2019).*

Jirawantnotai et al., 2020, Role of cyclins and cyclin-dependent kinases in pluripotent stem cells and their potential as a therapeutic target. In Seminars in cell & developmental biology (vol. 107, pp. 63-71). Academic Press. (Year: 2020).*

Khanday'2, (Published Dec. 2018), A male-expressed rice embryogenic trigger redirected for asexual propagation through seeds. Nature, 565(7737), 91-95. (Year: 2018).*

D'Erfurth et al., 2010, The cyclin-A CYCA1; 2/TAM is required for the meiosis I to meiosis II transition and cooperates with OSD1 for the prophase to first meiotic division transition. PLoS genetics, 6(6), e1000989. (Year: 2010).*

Brooks III et al., 2009, Microdissection of shoot meristem functional domains. PLoS genetics, 5(5), e1000476. (Year: 2009).*

Khanday'2, (Published Dec. 2018), A male-expressed rice embryogenic trigger redirected for asexual propagation through seeds (Extended Data). Nature, 565(7737), 91-95. (Year: 2018).*

Chen et al., 2017, Zygotic genome activation occurs shortly after fertilization in maize. The Plant Cell, 29(9), 2106-2125. (Year: 2017).*

Lowe et al., 2016, Morphogenic regulators Baby boom and Wuschel improve monocot transformation. The Plant Cell, 28(9), 1998-2015. (Year: 2016).*

Hu et al., 2010, Genome-wide analysis of cyclins in maize (*Zea mays*). Genet Mol Res, 9(3), 1490-1503. (Year: 2010).*

Quiroz et al., 2024, Haploid rhapsody: the molecular and cellular orchestra of in vivo haploid induction in plants. New Phytologist, 241(5), 1936-1949. (Year: 2024).*

Dante et al., 2014, Cyclin-dependent kinase complexes in developing maize endosperm: evidence for differential expression and functional specialization. Planta, 239, 493-509. (Year: 2014).*

Bilichak, Andriy; et al.: "Identification of BABY BOOM homolog in breat wheat," Agri Gene, Mar. 1, 2018 (Mar. 1, 2018), vol. 7, pp. 43-51.

Black, Joshua; et al.: "Synthetic transcription factors for cell fate reprogramming," Current Opinion in Genetics & Development, May 24, 2018 (May 24, 2018), vol. 52, pp. 13-21.

Cebolla, et al.: "The mitotic inhibitor ccs52 is required for endoreduplication and ploidy-dependent cell enlargement in plants," The EMBO Journal, 1999, vol. 18, No. 16, pp. 4476-4484.

Cheng, et al.: "Downregulation of multiple CDK inhibitor ICK/KRP genes upregulates the E2F pathway and increases cell proliferation, and organ and seed sizes in Arabidopsis," The Plant Journal, May 7, 2013 (May 7, 2013), vol. 75, pp. 642-655.

Cockcroft, et al.: "Cyclin D control of growth rate in plants," Nature, Jun. 1, 2000 (Jun. 1, 2000), vol. 405, pp. 575-579.

De Veylder, et al.: "Control of proliferation, endoreduplication and differentiation by the *Arabidopsis* E2Fa-DPa transcription factor," The EMBO Journal, 2002, vol. 21, No. 6, pp. 1360-1368.

Dewitte, et al.: "Altered Cell Cycle Distribution, Hyperplasia, and Inhibited Differentiation in *Arabidopsis* Caused by the D-Type Cyclin CYCD3," The Plant Cell, Jan. 2003 (Jan. 2003), vol. 15, pp. 79-92.

Feher, Attila: "Somatic embryogenesis—Stress-induced remodeling of plant cell fate," Biochimica et Biophysica Acta, Apr. 1, 2015 (Apr. 1, 2015), vol. 1849, No. 4, pp. 385-402.

Gordon-Kamm, et al.: "Stimulation of the cell cycle and maize transformation by disruption of the plant retinoblastoma pathway," PNAS, Sep. 3, 2002 (Sep. 3, 2002), vol. 99, No. 18, pp. 11975-11980.

Law, et al.: "Establishing, maintaining and modifying DNA methylation patters in plants and animals," Nature Reviews Genetics, Mar. 2010 (Mar. 2010), vol. 11, pp. 204-220.

Liu, Wusheng; et al.: "Plant synthetic promoters and transcription factors," Current Opinion in Biotechnology, Feb. 1, 2016 (Feb. 1, 2016), vol. 37, pp. 36-44.

Magyar, et al.: ", The Role of the *Arabidopsis* E2FB Transcription Factor in Regulating Auxin-Dependent Cell Division" The Plant Cell, Sep. 2005 (Sep. 2005), vol. 17, pp. 2527-2541.

Makarevitch, et al.: "Genomic Distribution of Maize Facultative Heterochromatin Marked by Trimethylation of H3K27," The Plant Cell, 2013, vol. 25, pp. 780-793.

Schnittger, et al.: "Ectopic D-type cyclin expression induces not only DNA replication but also cell division in Arabidopsis trichomes," PNAS, Apr. 30, 2002 (Apr. 30, 2002), vol. 99, No. 9, pp. 6410-6415.

Vijverberg, et al.: "Identifying and Engineering Genes for Parthenogenesis in Plants," Frontiers in Plant Science, Feb. 19, 2019 (Feb. 19, 2019), vol. 10, Article 128.

(56) References Cited

OTHER PUBLICATIONS

Vlieghe, et al.: "The DP-E2F-like Gene DEL1 Controls the Endocycle in *Arabidopsis thaliana*," Current Biology, Jan. 11, 2005 (Jan. 11, 2005), vol. 15, pp. 59-63.
Yu, et al.: "The Tobacco A-Type Cyclin, Nicta; CYCA3;2, at the Nexus of Cell Division and Differentiation," The Plant Cell, Dec. 2003 (Dec. 2003), vol. 15, pp. 2763-2777.
Zheng, M. Y.; et al.: "Production of doubled haploids in wheat (*Triticum aestivum* L.) through microspore embryogenesis triggered by inducer chemicals," Doubled Haploid Production in Crop Plants, Jan. 1, 2003 (Jan. 1, 2003), pp. 83-94.
International Search Report and Written Opinion for International Application No. PCT/US20/028815, Mailed Aug. 28, 2020.
Copenhaver G.P., et al., "Tetrad Analysis in Higher Plants. A Budding Technology," Plant Physiology, 2000, vol. 124, pp. 7-15.
Florez S.L., et al., "Enhanced Somatic Embryogenesis in Theobroma Cacao using the Homologous Baby Boom Transcription factor," BMC Plant Biology, 2015, vol. 15, No. 121, 13 pages.
Guo H.H., et al., "Protein Tolerance to Random Amino Acid Change," Proceedings of National Academy of Sciences, USA, Jun. 22, 2004, vol. 101, No. 25, pp. 9205-9210.
International Preliminary Report on Patentability for International Application No. PCT/US2018/055561, mailed Apr. 23, 2020, 10 Pages.
International Preliminary Report on Patentability for International Application No. PCT/US2020/021844, mailed Sep. 23, 2021, 14 Pages.
International Preliminary Report on Patentability for International Application No. PCT/US2020/028815, mailed Oct. 28, 2021, 11 Pages.
International Search Report and Written Opinion for International Application No. PCT/US2018/055561, mailed Mar. 8, 2019, 19 Pages.
International Search Report and Written Opinion for International Application No. PCT/US2020/021844, mailed Aug. 3, 2020, 24 Pages.
Kelliher T., et al., "One-step Genome Editing of Elite Crop Germplasm During Haploid Induction," Nature Biotechnology, Mar. 2019, vol. 37, pp. 287-292, 14 Pages.
Kunitake H., et al., "Isolation and Culture of Asparagus Microspore Protoplasts," Japanese Journal of Breeding, 1993, vol. 43, pp. 231-238.
Kunz C., et al., "Assessment and Improvement of Wheat Microspore Derived Embryo Induction and Regeneration," Journal of Plant Physiology, Feb. 1, 2000, vol. 156, No. 2, pp. 190-196.
Li X., et al., "Dissecting Meiotic Recombination based on Tetrad Analysis by Single-Microspore Sequencing in Maize," Nature Communications, Mar. 24, 2015, vol. 6, No. 6648, 9 Pages.
Lowe K., et al., "Morphogenic Regulators Baby Boom and Wuschel Improve Monocot Transformation", The Plant Cell, American Society of Plant Biologists, US, Sep. 10, 2016, 1998-2015, 1-25 Entire Document, vol. 28, No. 9, 19 Pages, DOI: 10.1105/tpc.16.00124, ISSN 1040-4651, XP055318109 [A].
Murovec J., et al., "Haploids and Doubled Haploids in Plant Breeding," Plant Breeding, 2012, pp. 87-106, 21 pages.
Rodriguez K., et al., "DNA-Dependent Homodimerization, Subcellular Partitioning, and Protein Destabilization Control WUSCHEL Levels and Spatial Patterning," Proceedings of the National Academy of Sciences of the United States of America, Sep. 26, 2016, vol. 113, No. 41, pp. E6307-E6315.
Stieglitz H., "Role of Beta-1, 3-Glucanase in Postmeiotic Microspore Release," Developmental Biology, 1977, vol. 57, pp. 87-97.
Weising K., et al., "Foreign Genes in Plants: Transfer, Structure, Expression and Applications," Annual Review of Genetics, 1988, vol. 22, pp. 421-477, DOI:10.1146/annurev.ge.22.120188.002225, XP055354643.
MaizeGDB Gene Record p. Zm00001eb315430, 2024, pp. 1-7, Retrieved from, Internet URL: https://www.maizegdb.org/gene_center/gene/Zm00001 d020772, Accessed Oct. 5, 2024.
Soni R., et al., "A family of cyclin D Homologs from Plants Differentially Controlled by Growth Regulators and Containing the Conserved Retinoblastoma Protein Interaction Motif," The Plant Cell, 1995, vol. 7, No. 1, pp. 85-103.

\* cited by examiner

EMBRYOGENESIS FACTORS FOR CELLULAR REPROGRAMMING OF A PLANT CELL

CROSS-REFERENCE TO RELATED APPLICATIONS

This application claims the benefit of PCT Application Serial Number PCT/US2020/028815, filed Apr. 17, 2020, which claims the benefit of U.S. Provisional Patent Application No. 62/835,500 filed on Apr. 18, 2019 and U.S. Provisional Patent Application No. 62/947,786 filed on Dec. 13, 2019, all of which are hereby incorporated herein in their entireties by reference.

FIELD OF THE DISCLOSURE

The present disclosure relates to the field of plant molecular biology, more particularly the present disclosure pertains to rapid, high efficiency methods for producing both non-transformed and transformed plants.

REFERENCE TO SEQUENCE LISTING SUBMITTED ELECTRONICALLY

The official copy of the sequence listing is submitted electronically via EFS-Web as an ASCII formatted sequence listing with a file named 20211013_8046-US-PCT_ST25 created on Oct. 13, 2021 and having a size of 1,984,908 bytes and is filed concurrently with the specification. The sequence listing contained in this ASCII formatted document is part of the specification and is herein incorporated by reference in its entirety.

BACKGROUND OF THE DISCLOSURE

Plant breeding programs identify new cultivars by screening numerous plants to identify individuals with desirable characteristics. Large numbers of progeny from crosses are typically grown and evaluated, ideally across multiple years and environments, to select the plants with the most desirable characteristics.

Typical breeding methods cross two parental plants and the filial 1 hybrid ($F_1$ hybrid), is the first filial generation. Hybrid vigor in a commercial $F_1$ hybrid is observed when two parental strains, (typically inbreds), from different heterotic groups are intercrossed. Hybrid vigor, the improved or increased function of any biological quality resulting from combining the genetic contributions of its parents, is important to commercial maize seed production. Commercial hybrid performance improvements require continued development of new inbred parental lines.

Maize inbred line development methods may use maternal (gynogenic) doubled haploid production, in which maternal haploid embryos are selected following the fertilization of the ear of a plant resultant from a first-generation cross that has been fertilized with pollen from a so-called "haploid inducer" line. Pollination of a female flower with pollen of a haploid inducer strain results in elevated levels of ovules that contain only the haploid maternal genome, as opposed to inheriting a copy of both the maternal and paternal genome, thus, creating maternal haploid embryos. Ovules within the female flower are the products of meiosis and each maternal ovule is a unique meiotically recombined haploid genome, thereby allowing immature maternal haploid embryos to be isolated and treated using in vitro tissue culture methods that include chromosome doubling treatments to rapidly enable generating maternal doubled haploid recombinant populations. Many of the maize maternal haploid embryos generated by fertilizing a target plant with pollen from a maize haploid inducer line fail to regenerate into a fertile, doubled haploid plant and few, if any, in vitro tissue culture and plantlet regeneration methods propagate multiple, fertile plants from one haploid embryo. Thus, there is a need for improving methods of producing doubled haploid plants from maternal gamete doubled haploids in maize.

Most maize inbreds are recalcitrant to microspore isolation, in vitro tissue culture, and plantlet regeneration methods to create paternal (androgenic) gamete doubled haploids. Thus, there is also a need for methods of producing doubled haploid plants from paternal gamete doubled haploids in maize.

Plant breeders would thus also benefit from methods of developing a population of recombinant inbred lines that do not require extensive pollination control methods or the prolonged time required for propagating self-fertilized lines into isogenic states.

SUMMARY OF THE DISCLOSURE

In an aspect, a method of generating a plant embryo comprising (a) obtaining an embryogenic cell by providing to a plant cell a cellular reprogramming agent to acquire an embryogenic cell fate in the plant cell, a cellular reprogramming agent is a cellular reprogramming polypeptide selected from the group consisting of (i) a morphogenic developmental gene polypeptide; or (ii) an embryogenesis factor polypeptide; or (iii) a deactivated CRISPR-Cas nuclease translational fusion polypeptide, a combination of (i) and (ii); a combination of (i) and (iii); a combination of (ii) and (iii); and (b) producing the plant embryo from the plant cell is provided.

In an aspect, the plant cell is a gametic cell. In an aspect, the gametic cells is a maternal gametic cell. In another aspect, the gametic cells is a paternal gametic cell.

In an aspect, the cellular reprogramming agent is not produced by a stably integrated recombinant DNA construct in the gametic cell. In another aspect, the cellular reprogramming agent is produced by a stably integrated recombinant DNA construct in the gametic cell.

In an aspect, the morphogenic developmental gene polypeptide is selected from the group consisting of (i) a WUS/WOX homeobox polypeptide; (ii) a Babyboom (BBM) polypeptide or an Ovule Development Protein 2 (ODP2) polypeptide; (iii) a LEC1 polypeptide; (iv) a combination of (i) and (ii); and (v) a combination of (i) and (iii).

In an aspect, the cellular reprogramming polypeptide further comprises a cell penetrating peptide (CPP).

In an aspect, the cellular reprogramming polypeptide further comprises a secretion signal peptide (SSP).

In an aspect, the cellular reprogramming factor is present in a tissue culture media.

In an aspect, method comprising co-culturing the microspore with an embryogenesis inducing suspension feeder cell culture, wherein the embryogenesis inducing suspension feeder cell culture expresses an embryogenesis inducing polypeptide or co-culturing the microspore with the cellular reprogramming factor in the culture media.

In an aspect, the embryogenesis factor polypeptide is selected from the group consisting of (i) a transcription factor bHLH30-like polypeptide; (ii) a hybrid D-type cyclin polypeptide; (iii) a mitogen-activated kinase protein polypeptide; (iv) a plant lipid transfer polypeptide; (v) a cyclin delta-2 polypeptide; (vi) an oberon-like protein-like polypeptide;

(vii) a polynucleotide adenylyltransferase polypeptide; (viii) a GATA zinc finger polypeptide; (ix) a homeobox-leucine zipper polypeptide; (x) a hydrolase polypeptide; (xi) a telomerase reverse transcriptase polypeptide; (xii) a zinc finger polypeptide; (xiii) a GRAS family transcription factor polypeptide; (xiv) a mlo defense gene homolog polypeptide; (xv) a 3-ketoacyl-CoA synthase 11-like polypeptide; (xvi) a phytosulfokine polypeptide; and (i) and combinations comprising any two or more embryogenesis factor polypeptides together;

In an aspect, the cellular reprogramming polypeptide is a cell cycle regulator polypeptide selected from the group of cell cycle regulators consisting of a cyclin dependent kinase (CDK).

In an aspect, cellular reprogramming polypeptides are selected from the group consisting of (i) an embryogenesis factor polypeptide and (ii) a cell cycle regulator polypeptide; (iii) a morphogenic developmental gene polypeptide; (iv) a combination of (i) and (ii); a combination of (ii) and (iii); or a combination of (i) and (ii) and (iii).

In an aspect, the method further comprising culturing a haploid plant embryo. In an aspect, the method comprising contacting a haploid plant embryo with a chromosome doubling agent for a period sufficient to generate a doubled haploid plant embryo. In an aspect, the method wherein the microspore is obtained from maize, rice, sorghum, brassica, soybean, wheat, and cotton.

In an aspect, a method of generating a haploid plant embryo comprising (a) providing a plant comprising an expression cassette, wherein the expression cassette comprises a haploid induction expression cassette, wherein the expression cassette comprises a egg cell preferred regulatory element operably linked to a polynucleotide encoding morphogenic developmental gene and embryogenesis factor and or cell cycle regulator polypeptides; (b) crossing the plant of (a) as the female parent with a male parent expressing a color marker; (c) isolating female haploid embryos; (d) contacting the haploid embryo with a chromosome doubling agent; and (e) producing a doubled haploid plant from the doubled haploid is provided.

In an aspect, a method for improving haploid induction of a maize haploid inducer comprising (a) providing a haploid inducer plant an expression cassette, wherein the expression cassette comprises a haploid induction expression cassette, wherein the expression cassette comprises a egg cell-preferred or pollen cell-preferred regulatory element operably linked to a polynucleotide encoding morphogenic developmental gene and or embryogenesis factor and or cell cycle regulator polypeptides; (b) crossing the plant of (a) with a female (c) isolating haploid embryos from the female parent; (d) contacting the haploid embryo with a chromosome doubling agent; and (e) producing a doubled haploid plant from the doubled haploid is provided.

In an aspect, a method of generating a haploid plant embryo comprising (a) providing a plant comprising an expression cassette, wherein the expression cassette comprises a dCas9 cellular reprogramming expression cassette, wherein the expression cassette comprises an egg cell-preferred or pollen cell-preferred regulatory element operably linked to a polynucleotide encoding deactivated Cas9 translational fusions polypeptides; (b) crossing the plant of (a) as the female parent with a male parent expressing a color marker; (c) isolating female haploid embryos; (d) contacting the haploid embryo with a chromosome doubling agent; and (e) producing a doubled haploid plant from the doubled haploid is provided.

In an aspect, a method of generating a haploid plant embryo comprising (a) providing a plant comprising an expression cassette, wherein the expression cassette comprises a tapetum cell preferred regulatory element operably linked to a polynucleotide encoding an cellular reprogramming polypeptide; (b) crossing the plant of (a) with a wild type inbred plant to provide an $F_1$ hybrid; (c) recovering an embryogenic microspore from the $F_1$ hybrid of (b); and (d) producing the haploid plant embryo from the embryogenic microspore is provided.

In an aspect, the cellular reprogramming polypeptide is a morphogenic developmental polypeptide. In an aspect, the cellular reprogramming polypeptide is an embryogenesis factor polypeptide. In an aspect, the cellular reprogramming polypeptide is a cell cycle regulator polypeptide.

In an aspect, the cellular reprogramming polypeptide is selected from the group consisting of (i) an embryogenesis factor polypeptide and (ii) a cell cycle regulator polypeptide; and (iii) a morphogenic developmental gene polypeptide; (iv) a combination of (i) and (ii); a combination of (ii) and (iii); or a combination of (i) and (ii) and (iii).

In an aspect, the morphogenic developmental polypeptide is selected from the group consisting of (i) a WUS/WOX homeobox polypeptide; (ii) a Babyboom (BBM) polypeptide or an Ovule Development Protein 2 (ODP2) polypeptide; (iii) a LEC1 polypeptide.

In an aspect, the method further comprising modifying genomic DNA by a site-specific nuclease. In an aspect, the expression cassette further comprises a polynucleotide encoding a site-specific nuclease. In an aspect, the site-specific nuclease is selected from the group consisting of a zinc finger nuclease, a meganuclease, TALEN, and a CRISPR-Cas endonuclease. In an aspect, the CRISPR-Cas nuclease is a Cas9, Cpf1, or a Cas-alpha (Casa) nuclease. In an aspect, the modification of genomic DNA is made by a Cas endonuclease during microspore embryogenesis. In an aspect, the modification of DNA is an insertion, a deletion, or a substitution mutation. In an aspect, the Cas endonuclease is expressed from the expression cassette, the Cas endonuclease further comprising a cell penetrating peptide. In an aspect, the method further comprising providing a guide RNA expressed from the expression cassette. In an aspect, the modification of DNA is performed by providing a guide RNA and Cas endonuclease as a ribonucleoprotein complex exogenously to the embryogenic microspore. In an aspect, the plant is homozygous for the expression cassette.

In an aspect, the expression cassette further comprises a signal peptide. In an aspect, the expression cassette further comprises a cell penetrating peptide (CPP). In an aspect, the method further comprising contacting the haploid plant embryo with a chromosome doubling agent for a period sufficient to generate a doubled haploid plant embryo. In an aspect, the plant is maize, rice, sorghum, brassica, soybean, wheat, or cotton. In an aspect, the method further comprising regenerating a doubled haploid plant from the doubled haploid plant embryo.

In an aspect, a method of generating a doubled haploid plant comprising (a) providing a plant comprising an expression cassette, wherein the expression cassette comprises an endosperm cell preferred regulatory element operably linked to a polynucleotide encoding an embryogenesis inducing polypeptide; (b) crossing the plant of (a) with a wild type $F_1$ hybrid; (c) recovering a haploid embryo from the cross of (b); (d) contacting the haploid embryo with a chromosome doubling agent for a period sufficient to generate a doubled haploid embryo; and (e) regenerating the doubled haploid plant from the doubled haploid embryo of (d) is provided.

In an aspect, the embryogenesis inducing polypeptide is a morphogenic developmental polypeptide. In an aspect, the morphogenic developmental polypeptide is selected from the group consisting of (i) a WUS/WOX homeobox polypeptide; (ii) a Babyboom (BBM) polypeptide or an Ovule Development Protein 2 (ODP2) polypeptide; (iii) a LEC1 polypeptide; (iv) a combination of (i) and (ii); and (v) a combination of (i) and (iii). In an aspect, the expression cassette further comprises a polynucleotide encoding a gene-editing nuclease. In an aspect, the method further comprising modifying genomic DNA by a site-specific nuclease. In an aspect, the expression cassette further comprises a polynucleotide encoding a site-specific nuclease. In an aspect, the site-specific nuclease is selected from the group consisting of a zinc finger nuclease, a meganuclease, TALEN, and a CRISPR-Cas endonuclease. In an aspect, the CRISPR-Cas nuclease is Cas9 or Cpf1 nuclease. In an aspect, the modification of genomic DNA is made by a Cas endonuclease during haploid embryo embryogenesis. In an aspect, the modification of DNA is an insertion, deletion, or a substitution mutation. In an aspect, the Cas endonuclease is expressed from the expression cassette, the Cas endonuclease further comprising a cell penetrating peptide. In an aspect, the method further comprising providing a guide RNA expressed from the expression cassette. In an aspect, the modification of DNA is performed by providing a guide RNA and Cas endonuclease as a ribonucleoprotein complex exogenously to the embryogenic haploid embryo. In an aspect, the plant is homozygous for the expression cassette. In an aspect, the expression cassette further comprises a signal peptide. In an aspect, the expression cassette further comprises a cell penetrating peptide (CPP). In an aspect, the expression cassette further comprises a polynucleotide encoding a color marker, or a fluorescent marker operably linked to regulatory element. In an aspect, recovering the haploid embryo comprises screening for the presence or the absence of the color marker, the fluorescent marker, or the regulatory element. In an aspect, the screening occurs in a cell viability and cell sorting microfluidics device for automated fluorescence detection for identifying, sorting, and selecting a haploid embryo comprising the expression cassette from a haploid embryo not comprising the expression cassette.

In an aspect, an embryogenic microspore comprising an increased amount of an embryogenesis inducing polypeptide compared to a control microspore, wherein the polypeptide is not produced in the microspore is provided. In an aspect, an embryoid or embryogenic tissue produced from the embryogenic microspore is provided. In an aspect, an embryogenic microspore comprising a heterologous cellular reprogramming agent, wherein the heterologous cellular reprogramming agent is not produced in the microspore is provided. In an aspect, the cellular reprogramming agent is selected from the group consisting of (i) an embryogenesis inducing polypeptide; or (ii) an embryogenesis inducing compound; or (iii) a combination of (i) and (ii). In an aspect, the embryogenesis inducing polypeptide is selected from the group consisting of (i) a WUS/WOX homeobox polypeptide; (ii) a Babyboom (BBM) polypeptide or an Ovule Development Protein 2 (ODP2) polypeptide; (iii) a LEC1 polypeptide; (iv) a combination of (i) and (ii); and (v) a combination of (i) and (iii). In an aspect, the embryogenesis inducing compound is hemin or a kinase inhibitor or a combination thereof. In an aspect, the embryogenic microspore is capable of producing a haploid embryo. In an aspect, the embryogenic microspore is a maize embryogenic microspore. In an aspect, the embryogenic microspore is from rice, sorghum, brassica, soybean, wheat, or cotton. In an aspect, a plant cell comprising an expression cassette, wherein the expression cassette comprises a tapetum cell preferred regulatory element operably linked to a polynucleotide encoding an embryogenesis inducing polypeptide, and wherein the embryogenesis inducing polypeptide is capable of being secreted or transported into a microspore is provided. In an aspect, the embryogenesis inducing polypeptide comprises a cell penetrating peptide. In an aspect, the embryogenesis inducing polypeptide is a morphogenic developmental polypeptide selected from the group consisting of (i) a WUS/WOX homeobox polypeptide; (ii) a Babyboom (BBM) polypeptide or an Ovule Development Protein 2 (ODP2) polypeptide; (iii) a LEC1 polypeptide; (iv) a combination of (i) and (ii); and (v) a combination of (i) and (iii). In an aspect, a plant cell comprising an expression cassette, wherein the expression cassette comprises an endosperm cell preferred regulatory element operably linked to a polynucleotide encoding an embryogenesis inducing polypeptide and wherein the embryogenesis inducing polypeptide is produced in an endosperm cell, the embryo surrounding region (ESR), the Basal Endosperm Transfer Layer (BETL) or a combination thereof and capable of being secreted or transported into an embryo cell is provided. In an aspect, a population of plant cells comprising the plant cell and the embryo cell, wherein the embryo cell comprises the secreted or transported embryogenesis inducing polypeptide is provided. In an aspect, the embryogenesis inducing polypeptide is a morphogenic developmental polypeptide selected from the group consisting of (i) a WUS/WOX homeobox polypeptide; (ii) a Babyboom (BBM) polypeptide or an Ovule Development Protein 2 (ODP2) polypeptide; (iii) a LEC1 polypeptide; (iv) a combination of (i) and (ii); and (v) a combination of (i) and (iii).

DESCRIPTION OF THE FIGURES

FIG. 4A shows the ratio of embryo-like structures (ELS) productivity in response to particle bombardment with expression vectors containing i) WUS2 and ODP2/BBM polynucleotides (labeled DG, (SEQ ID NO: 210)), ii) a dCas9-CBF1A polynucleotide without a gRNA (labeled dCas9, (SEQ ID NO: 85)), iii) gRNA molecules targeting the WUS and BBM genomic sites without a dCas9-CBF1A polynucleotide (labeled gRNA, PHP89615 (SEQ ID NO: 201), PHP89613 (SEQ ID NO: 203), PHP89611 (SEQ ID NO: 205), and RV038531 (SEQ ID NO: 206)), iv) a combination of the gRNA molecules targeting the WUS and BBM genomic sites and the dCas9-CBF1A expression plasmids (labeled RNP), and v) un-labelled gold particles (labeled gold). All of the above treatments were normalized relative to non-treated control (NTC) cells. The hatched and solid bars represent two (2) replicates of the experiment. FIG. 4B and FIG. 4C show images of embryoids developing in response to iv) the RNP treatment targeting the WUS and BBM genomic sites (5 mm and 3 mm scale bars for FIG. 4B and FIG. 4C, respectively). FIG. 4D shows a microspore embryo like structure (ELS) in response to iii) the gRNA treatment using freshly isolated microspores (Line 1=0.9 mm). FIG. 4E shows an embryoid developing in response to the iii) gRNA treatment using 14-day microspore cultures (0.5 mm scale bar).

(FIG. 5A) (4 mm scale bar) the no bombardment control treatment 14 days post-bombardment, (FIG. 5B) (6 mm scale bar) the dCas9-HAT1 RNP treatment 14 days post-bombardment, (FIG. 5C) the no bombardment control treatment 28 days post-bombardment (imaged within a 100 mm diameter petri dish), and (FIG. 5D) the dCas9-HAT1 RNP treatment 28 days post-bombardment (imaged within a 100 mm diameter petri dish).

FIG. 8A and FIG. 8B show CFP and RFP expression in diploid and haploid embryos of the two (2) independent events under brightfield illumination. FIG. 8C and FIG. 8D show CFP and RFP expression in diploid and haploid embryos of the two (2) independent events under fluorescent illumination. FIG. 8E and FIG. 8F show CFP and RFP expression in diploid and haploid embryos of the two (2) independent events under fluorescent illumination. In FIG. 8C and FIG. 8D, haploid detection was shown by identifying CFP-minus embryos for the two (2) independent events. In FIG. 8E and FIG. 8F haploids with putative CRE excision events were shown by identifying CFP-minus and RFP-minus embryos for the two (2) independent events.

DETAILED DESCRIPTION

Figure 1:
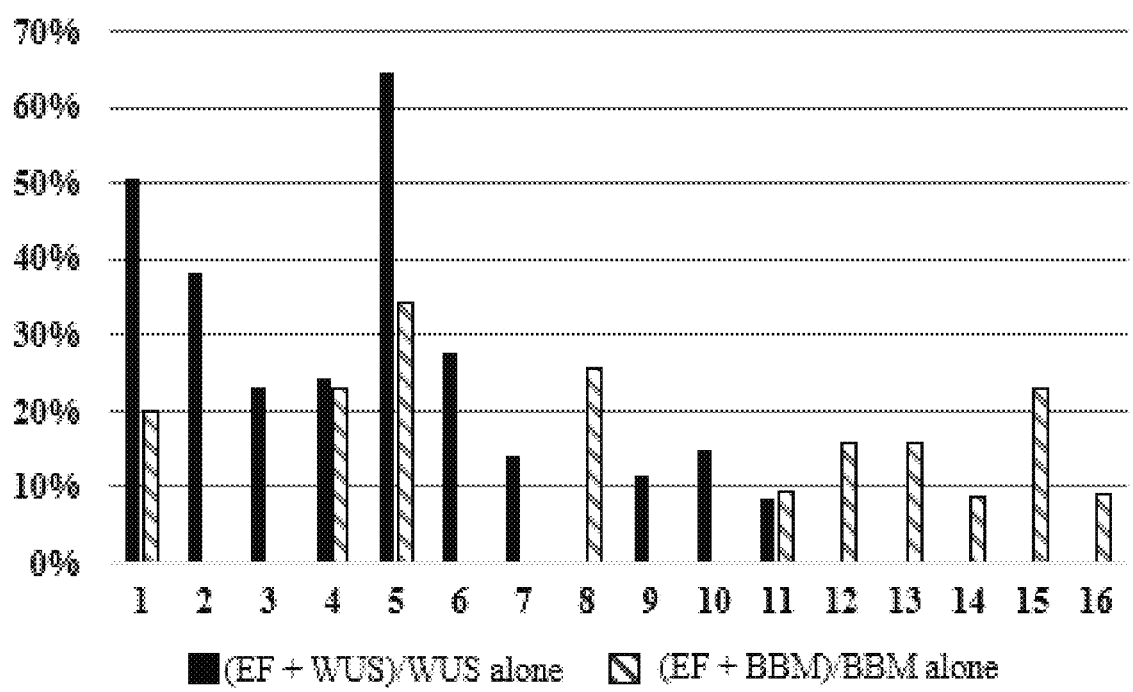
FIG. 1 shows the relative efficacy of somatic embryogenesis induction after 14 days. The relative efficacy of somatic embryogenesis is shown as the percent change (%; y axis) of responsive embryos exhibiting somatic embryogenesis development at 14 days after infection with an experimental plasmid relative to a control plasmid. Relative efficacy of somatic embryogenesis is shown for each of the embryogenesis factors1-16.

The disclosures herein will be described more fully hereinafter with reference to the accompanying figures, in which some, but not all possible aspects are shown. Indeed, disclosures may be embodied in many different forms and should not be construed as limited to the aspects set forth herein; rather, these aspects are provided so that this disclosure will satisfy applicable legal requirements.

Many modifications and other aspects disclosed herein will come to mind to one skilled in the art to which the disclosed methods and compositions pertain having the benefit of the teachings presented in the following descriptions and the associated figures. Therefore, it is to be understood that the disclosures are not to be limited to the specific aspects disclosed and that modifications and other aspects are intended to be included within the scope of the appended claims. Although specific terms are employed herein, they are used in a generic and descriptive sense only and not for purposes of limitation.

It is also to be understood that the terminology used herein is for the purpose of describing particular aspects only and is not intended to be limiting. As used in the specification and in the claims, the term "comprising" can include the aspect of "consisting of." Unless defined otherwise, all technical and scientific terms used herein have the same meaning as commonly understood by one of ordinary skill in the art to which the disclosed methods and compositions belong. In this specification and in the claims which follow, reference will be made to a number of terms which shall be defined herein.

As used herein the singular forms "a", "an", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

All patents, publications and patent applications mentioned in the specification are indicative of the level of those skilled in the art to which this disclosure pertains. All patents, publications and patent applications are herein incorporated by reference in the entirety to the same extent as if each individual patent, publication or patent application was specifically and individually indicated to be incorporated by reference in its entirety.

In plants, germ line cells (germline) provide the transgenerational inheritance of genetic information in each subsequent generation by producing spore mother cells during sporogenesis. For example, sporogenesis provides the megaspore mother cell that develops the female gametes, the egg cell and central cell that give rise to the embryo and endosperm, respectively; or the microspore mother cell that develops the male gamete, giving rise to four haploid microspores, wherein each microspore further develops into a mature pollen grain. A key aspect for the unique role of germline cells is providing the genetic information a future offspring receives, wherein half of the genetic contribution is from the female gamete and half of the genetic contribution is from the male gamete. Fertilization of the egg cell with one sperm cell forms a diploid zygote, while a second sperm cells fuses with the two polar nuclei of the central cell to form a triploid endosperm. The endosperm is a terminally nourishing tissue for the embryo yet does not contribute to the germline. After fertilization, the zygote gives rise to an embryo, a process referred to as zygotic embryogenesis that is characteristic of sexual reproduction. A newly formed embryo undergoing such an embryogenesis developmental program comprising an underlying regulatory program affected by genetic determinants and epigenetic reprogramming leading from an embryogenic cell state to the acquisition of a differentiated cell fate, or cell fates, ultimately giving rise to a plant with all differentiated tissues thereof.

The methods of the present disclosure can alter such developmental programs of plant sexual reproduction described above. Such methods are valuable as plant reproduction methods for agricultural use. For example, mechanisms regarding the transition from a sporophytic fate to a reproductive fate or reverting an acquired cell state from a differentiated cell state to an embryogenic cell state (e.g. a germline, or pluripotent cell state) are specifically of interest. The present disclosure provides methods using molecular mechanisms underlying cellular reprogramming technologies that are useful for agricultural use and crop improvement.

Cellular reprogramming refers to the method of providing a stimulus to alter the cell fate of a treated cell. Often cellular reprogramming comprises reverting a differentiated, more specialized cell towards an induced pluripotent stem cell state. Such methods can also comprise trans-differentiation, defined as the transformation of a cell other than a stem cell into a second cell type.

As used herein, "reprogram" or "reprograming" or "reprogramed" is a process of reverting or sensitizing mature, specialized cells into induced pluripotent stem cells or into cells in an embryonic/embryogenic state capable of being further developed into an embryo or embryo-like structure. In a population of cells that are being "reprogrammed" not all cells are expected to be "reprogrammed" to the same extent or to the same embryonic/embryogenic state. A mixture or mosaic of cells at various states of reprogramming is generally expected. Methods and compositions provided herein are expected to increase the ratio or percent of cells that are reprogrammed and in a desired embryonic/embryogenic state compared to cells that have not been exposed to the methods and compositions provided herein. Reprograming also refers to the re-establishment of germ cell development. Reprograming can occur when an embryogenesis inducing polypeptide and/or a small molecule compound is contacted with plant cells rendering the plant cells embryogenic. The methods of the present disclosure provide contacting a haploid plant cell with an embryogenesis inducing agent such as for example, a polypeptide and/or a small molecule compound to reprogram cell fate and cause the cell to become embryogenic. Alternatively, a polynucleotide encoding an embryogenesis inducing polypeptide may be introduced and expressed in a plant cell wherein the embryogenesis inducing polypeptide impacts surrounding/adjacent cells thereby rendering those surrounding/adjacent cells embryogenic. The cells may be reprogrammed in planta or ex situ.

As used herein, a "cellular reprogramming factor" or an "embryogenesis inducing agent" includes, but is not limited to, small molecules, compounds, embryogenesis factor gene products and morphogenic developmental gene embryogenesis inducing gene products that function in cell fate reprogramming either independently or in concert, including for example, microspore embryogenesis induction. When a cell is contacted with a small molecule, it is believed that these reprogramming molecules activate expression of endogenous genes within the cell eliciting an embryogenesis response in the contacted cell.

As used herein, a "cellular reprogramming treatment" is any of the treatments disclosed herein that elicits an embryogenesis response in the contacted cell.

The use of a cellular reprogramming agent (an embryogenesis inducing polypeptide or an embryogenesis inducing compound) or a cellular reprogramming treatment of a plant cell inside of the tissue of the organism, prior to cell isolation or cell extraction for experimentation and/or measurements done in an external environment is referred to as an "in planta" treatment or treatment method.

Cellular reprogramming affects cell fate and can result in various types of cell fate changes. One cell fate is a cell becoming totipotent, characterized as a cell that can form the sporophyte and extraembryonic cells, such as endosperm cells in the case of plants. Another cell fate is a cell becoming pluripotent, characterized as a cell that can give rise to all the cell types comprising the sporophyte, excluding extraembryonic cells. Embryogenic cells capable of direct organogenesis can be considered as pluripotent. Another cell fate is characterized as a cell becoming multipotent, defined as a cell that can develop into more than one cell type, but being more limited than pluripotent cells, such as plant cells undergoing indirect organogenesis. Reprogramming can also refer to the erasure of epigenetic marks characteristic of a differentiated, or a more specialized cell state and re-establishment of epigenetic marks characteristic of an embryogenic cell state.

The present disclosure comprises methods for cellular reprogramming to produce either a non-transgenic or a transgenic plant using embryogenesis factors as cellular reprogramming agents. These embryogenesis factors can be used in combination with a morphogenic gene.

The present disclosure also comprises methods for cellular reprogramming to produce either a non-transgenic or a transgenic plant by treating a cell with a heterologous protein as the cellular reprogramming agent, including a heterologous protein complexed with a guide RNA, capable of altering gene regulation of an endogenous locus encoding an embryogenesis factor. The heterologous protein used as the cellular reprogramming agent can also be used to recruit the heterologous protein/gRNA complex to an endogenous locus encoding an embryogenesis factor in combination with gRNA for recruiting the heterologous protein/gRNA complex to a locus encoding a morphogenic gene.

The present disclosure provides methods of producing transgenic plants by rapidly inducing somatic embryogenesis in wild type cells using an embryogenesis factor alone or in combination with a morphogenic gene. These methods are useful in plant breeding programs, and particularly, in crop plant breeding programs.

The present disclosure also provides methods of generating non-transgenic microspore-derived doubled haploid populations by co-culturing microspores with a purified protein, such as an embryogenesis factor gene product protein with or without a chemical treatment.

The present disclosure also provides methods to improve productivity of a maize maternal doubled haploid system, specifically by improving the regeneration of haploid plants per sampled haploid embryo.

As used herein, "asexual reproduction" means reproduction without the fusion of gametes.

As used herein, "central cell" means the female gamete giving rise to the endosperm.

As used herein, "egg cell" means the female gamete giving rise to the embryo.

As used herein, "megaspore mother cell" means the cell that develops into the female gametophyte, also known as a megasporocyte, or functional megaspore (FMS).

As used herein, "microspore mother cell" means the cell that develops into the male gametophyte, also known as a microsporocyte.

As used herein, "gametogenesis" means the development of gametophytes from spores.

As used herein, "parthenogenesis" means the formation of an embryo from an unfertilized egg cell.

As used herein, "pseudogamy" means the fertilization-dependent formation of endosperm from a central cell.

As used herein, "sexual reproduction" means the mode of reproduction whereby female (egg) and male (sperm) gametes fuse to form a zygote.

As used herein, "somatic embryogenesis" means the formation of an embryo from a sporophytic cell without gamete and seed formation.

As used herein, "sporogenesis" means the formation of spores from spore mother cells.

As used herein, "spore mother cell" means the first cell of the reproductive lineage, formed from sporophytic cells in female and male reproductive tissues of the plant.

As used herein, "vegetative reproduction" means a form of reproduction in which a new plant is formed without the formation of an embryo.

As used herein, the term "embryo" means embryos and progeny of the same, immature and mature embryos, immature zygotic embryo, zygotic embryos, somatic embryos, embryogenic callus, and embryos derived from mature ear-derived seed. An embryo is a structure that is capable of germinating to form a plant.

As used herein, "haploid" means a plant or a plant cell having a single set (genome) of chromosomes and the reduced number of chromosomes (n) is equal to that in the gamete.

As used herein, the term "1n" or "1n cell" means a cell containing a single set of chromosomes, typically the product of meiosis. Examples of a 1n cell include gametes such as sperm cells, egg cells, or tissues derived from a gamete through mitotic divisions, such as a 1n embryo or a 1n plant. In maize where the plant is normally diploid, and the gametes are haploid, such gamete-derived embryos or plants are referred to as haploid embryos and haploid plants.

As used herein, "diploid" means a plant or a plant cell having two sets (genomes) of chromosomes and the chromosome number (2n) is equal to that in the zygote.

As used herein, the term "2n" or "2n cell" means a cell containing two sets of chromosomes. Examples of 2n cells include a zygote, an embryo resulting from mitotic divisions of a zygote, or a plant produced by germination of a 2n embryo.

As used herein, "haploid plant" means a plant having a single set (genome) of chromosomes and the reduced number of chromosomes (n) is equal to that in the gamete.

As used herein, the term "diploid plant" means a plant having two sets (genomes) of chromosomes and the chromosome number (2n) is equal to that in the zygote.

As used herein, "doubled haploid" means a haploid cell is one with a single genome, male or female.

As used herein, the "anther" is part of the stamen containing the microsporangia that is attached to the filament. In angiosperms (flowering plants), the microsporangia produce microsporocyte, also known as the microspore mother cell, which then produces four microspores through meiosis. The microspores divide through mitosis to create pollen grains.

As used herein, the "locule" is a compartment within anthers containing the male gametes during microgametogenesis.

The term "microgametogenesis" is the process in plant reproduction where a microgametophyte, herein called a "microspore", develops into a tricellular pollen grain.

As used herein, the "microsporangium" or plural "microsporangia" is a sporangium that produces spores that give rise to male gametophytes. In nearly all land plants, sporangia are the site of meiosis and produce genetically distinct haploid spores.

The term "microspore embryogenesis" means the activation of androgenic embryogenesis of microspores that results or induces microspores to be in an embryogenic state.

The term "microspore-derived embryo" or "microspore-derived embryoid" means a cell or cells derived from a microspore with a cell fate and development characteristic of cells undergoing embryogenesis. An embryo or an embryoid is an organized structure capable of germinating in vitro to produce a plantlet.

The term "androgenic" means induction of androgenesis in which the embryo contains only paternal chromosomes (parthenogenesis) for haploid or diploid cells.

As used herein, a "haploid" plant has a single set (genome) of chromosomes and the reduced number of chromosomes (n) in the haploid plant is equal to that in the gamete.

As used herein, a "diploid" plant has two sets (genomes) of chromosomes and the chromosome number (2n) is equal to that in the zygote.

As used herein, a "doubled haploid" or a "doubled haploid plant or cell" is one that is developed by the doubling of a haploid set of chromosomes. A plant or seed that is obtained from a doubled haploid plant that is selfed any number of generations may still be identified as a doubled haploid plant. A doubled haploid plant is considered a homozygous plant. A plant is a doubled haploid if it is fertile, even if the entire vegetative part of the plant does not consist of the cells with the doubled set of chromosomes. For example, a plant will be considered a doubled haploid plant if it contains viable gametes, even if it is chimeric.

As used herein, a "doubled haploid embryo" is an embryo that has one or more cells containing 2 sets of homozygous chromosomes that can then be grown into a doubled haploid plant.

As used herein, the term "clonal" means multiple propagated plant cells or plants that are genetically, epigenetically and morphologically identical.

As used herein, the term "gamete" means a 1n reproductive cell such as a sperm cell, an egg cell or an ovule cell resulting from meiosis.

As used herein, the term "haploid embryo" means a gamete-derived somatic structure.

As used herein, the term "somatic structure" means a tissue, organ or organism.

As used herein, the term "somatic cell" is a cell that is not a gamete. Somatic cells, tissues or plants can be haploid, diploid, triploid, tetraploid, hexaploid, etc. A complete set of chromosomes is referred to as being 1n (haploid), with the number of chromosomes found in a single set of chromosomes being referred to as the monoploid number (x). For example, in the diploid plant Zea mays, 2n=2x=20 total chromosomes, while in diploid rice Oryza sativa, 2n=2x=24 total chromosomes. In a triploid plant, such as banana, 2n=3x=33 total chromosomes. In hexaploid wheat Triticum aestivum, 2n=6x=42. Ploidy levels can also vary between cultivars within the same species, such as in sugarcane, Saccharum officinarum, where 2n=10x=80 chromosomes, but commercial sugarcane varieties range from 100 to 130 chromosomes.

As used herein, the term "medium" includes compounds in a liquid state, a gaseous state, or a solid state.

As used herein, the term "selectable marker" means a transgene that when expressed in a transformed/transfected cell confers resistance to selective agents such as antibiotics, herbicides and other compounds toxic to an untransformed/untransfected cell.

As used herein, the term "EAR" means an "Ethylene-responsive element binding factor-associated Amphiphilic Repression motif" with a general consensus sequence of LLxLxL, DNLxxP, LxLxPP, R/KLFGV, or TLLLFR that act as transcriptional repression signals within transcription factors. Addition of an EAR-type repressor element to a DNA-binding protein such as a transcription factor, dCAS9, or LEXA (as examples) confers transcriptional repression function to the fusion protein (Kagale, S., and Rozwadowski, K. 2010. Plant Signaling and Behavior 5:691-694).

As used herein, the term "transcription factor" means a protein that controls the rate of transcription of specific genes by binding to the DNA sequence of the promoter and either up-regulating or down-regulating expression. Examples of transcription factors, which are also morphogenic genes, include members of the AP2/EREBP family (including the BBM (ODP2), plethora and ainteguinenta sub-families, CAAT-box binding proteins such as LEC1 and HAP3, and members of the MYB, bHLH, NAC, MADS, bZIP and WRKY families.

As used herein, the term "synthetic transcription factor" refers to a molecule comprising at least two domains, a recognition domain and a regulatory domain not naturally occurring in nature.

As used herein, the term "expression cassette" means a distinct component of vector DNA consisting of coding and non-coding sequences including 5' and 3' regulatory sequences that control expression in a transformed/transfected cell.

As used herein, the term "coding sequence" means the portion of DNA sequence bounded by a start and a stop codon that encodes the amino acids of a protein.

As used herein, the term "non-coding sequence" means the portions of a DNA sequence that are transcribed to produce a messenger RNA, but that do not encode the amino acids of a protein, such as 5' untranslated regions, introns and 3' untranslated regions. Non-coding sequence can also refer to RNA molecules such as micro-RNAs, interfering RNA or RNA hairpins, that when expressed can down-regulate expression of an endogenous gene or another transgene.

As used herein, the term "regulatory sequence" means a segment of a nucleic acid molecule which is capable of increasing or decreasing the expression of a gene. Regulatory sequences include promoters, terminators, enhancer elements, silencing elements, 5' UTR and 3' UTR (untranslated region).

As used herein, the term "transfer cassette" means a T-DNA comprising an expression cassette or expression cassettes flanked by the right border and the left border.

As used herein, the term "T-DNA" means a portion of a Ti plasmid that is inserted into the genome of a host plant cell.

As used herein, the term "embryogenesis factor" means a gene that when expressed enhances cellular reprogramming that can promote improved formation of a somatically-derived structure. More precisely, ectopic expression of an embryogenesis factor stimulates de novo formation of an organogenic structure, for example a structure from embryogenic callus tissue, that can improve the formation of an embryo. This stimulated de novo embryogenic formation occurs either in the cell in which the embryogenesis factor is expressed, or in a neighboring cell. An embryogenesis factor gene can be a transcription factor that regulates expression of other genes, or a gene that influences hormone levels in a plant cell, or a gene that influences an enzyme affecting cellular reprogramming in a plant cell, any of which can stimulate embryogenic changes. As used herein, the term "embryogenesis factor" means an embryogenesis factor gene and/or the protein expressed by an embryogenesis factor gene acting as a cellular reprogramming agent.

An embryogenesis factor is involved in plant metabolism, organ development, stem cell development, cell growth stimulation, organogenesis, somatic embryogenesis initiation, accelerated somatic embryo maturation, initiation and/or development of the apical meristem, initiation and/or development of shoot meristem, or a combination thereof.

Identification of embryogenesis factors and/or methods for altering the regulation of genes encoding embryogenesis factors that result in the induction of cellular reprogramming, particularly in recalcitrant cell types or in cells of recalcitrant species or recalcitrant genotypes is a useful technology for plant breeding methods. The present methods are useful for plant breeding methods including, plant transformation methods, doubled haploid plant production methods, or combinations thereof, using embryogenesis factors as cellular reprogramming agents, and using methods comprising treating a cell with a heterologous protein to regulate an endogenous locus in a cell's genome encoding an embryogenesis factor.

The embryogenesis factors disclosed herein are involved in stimulating in vitro embryogenesis characterized by embryos developing ex planta, for example from microspores contacted with an embryogenesis factor.

In an aspect, an embryogenesis factor disclosed herein is involved in stimulating in vivo embryogenesis characterized by embryos developing in planta, for example from egg cells contacted with an embryogenesis factor. In an aspect, an embryogenesis factor disclosed herein is involved in stimulating embryogenesis in cells from other plant tissues including, but not limited to, protoplasts, leaves, hypocotyls, or any other plant explant useful for sporophytic embryogenesis methods.

In an aspect, the present disclosure provides a method for producing haploid plants, comprising expression of an embryogenesis factor in egg cells of a sexually reproducing plant resulting in an increased percentage of progeny that contain half the number of chromosomes compared to the parent.

In an aspect, the present disclosure provides a method for producing haploid plants, comprising (a) infecting a plant cell with a bacterial strain containing a plasmid that comprises a transfer-DNA containing a degenerate Cas9 fusion protein gene and a guide RNA with sequence identify to a locus encoding an embryogenesis factor gene, and (b) expressing the degenerate Cas9 fusion protein in a cell to stimulate cellular reprogramming resulting in the acquisition of an embryogenic cell fate, and (c) regenerating a plant from the treated cell. In an aspect, the treated cell is a sporophytic cell with an equal number of chromosomes compared to the parent.

In an aspect, the treated cell is a gametophytic cell with half the number of chromosomes compared to the parent. In an aspect, the present disclosure provides a method for producing plants using asexual reproduction. Apogamy, a type of reproduction of flowering plants, is characterized by a diploid cell in the embryo sac developing into an embryo without being fertilized. Parthenogenesis is one form of apogamy and in a broader sense can include de novo embryogenic formation from a haploid gametophytic cell, for example an egg cell resulting from megasporogenesis, or a microspore resulting from microsporogenesis.

In an aspect, the present disclosure provides a method of (a) infecting a plant cell with a bacterial strain containing a plasmid that comprises a transfer-DNA containing an embryogenesis factor gene operably linked to a regulatory element active prior to, or during megasporogenesis, and (b) regenerating progeny in the absence of sexual fertilization in the egg cell to produce apomictic clones.

For plant cells and maize microspores in particular, the present disclosure provides methods of improving cellular reprogramming developmental fate toward embryogenesis including improving stress adaptive processes caused by cell separation and isolation techniques. In an aspect, methods to inhibit proplastids within microspores from developing to amyloplast, or methods to dedifferentiate an amyloplast to a proplastid, or to promote autophagy within maize microspores are provided.

The present disclosure provides efficient and effective methods of producing populations of recombinant inbred lines including, but not limited to, methods of initiating embryogenesis in plant cells to enable generation of doubled haploid recombinant populations. The disclosure also provides methods of enabling cellular reprogramming and embryogenic growth stimulation in non-transformed cells, and particularly in gametes or haploid cells during the development of the gametes or haploid cells. The present disclosure provides methods of promoting microspore embryogenesis in a cell, tissue or organ of a plant by contacting the cell, tissue or organ with an cellular reprogramming factor, including embryogenesis factors, capable of reprogramming the cell, tissue or organ wherein embryogenesis is induced in the cell, tissue or organ, such as, for example, an embryogenesis inducing compound.

The present disclosure provides methods for reprogramming microspores by co-culturing microspores with a purified protein, such as an embryogenesis factor gene product. In another aspect, methods are provided for reprogramming microspores by co-culturing microspores in the presence of cells expressing an embryogenesis factor gene product. Periods of co-cultivation (contact) with the embryogenesis inducing cellular reprograming agents will vary depending on the recalcitrance of the microspores being treated. For example, in an aspect, microspore embryogenesis is evidenced by the presence of multicellular structures (MCS) within the sporopollenin coat and/or rupturing of the exine of the microspore and/or the presence of embryo-like structures (ELS). In an aspect, the microspores are co-cultured with the embryogenesis inducing cellular reprograming agents until certain characteristics such as MCS and/or ELS are observed. Alternatively, other phenotypic and/or genotypic markers are also used to determine the embryogenic state or the cellular reprogramming state of treated microspores. Generally, co-cultivation for periods of less than an hour, an hour, two hours, three hours, four hours, five hours, six hours, seven hours, eight hours, nine hours, ten hours, eleven hours, twelve hours, thirteen hours, fourteen hours, fifteen hours, sixteen hours, seventeen hours, eighteen hours, nineteen hours, twenty hours, twenty one hours, twenty two hours, twenty three hours, twenty four hours, two days, three days, four days, five days, six days, seven days, eight days, nine days, ten days, eleven days, twelve days, thirteen days, fourteen days, fifteen days, sixteen days, seventeen days, eighteen days, nineteen days, twenty days, twenty one days, twenty two days, twenty three days, twenty four days, twenty five days, twenty six days, twenty seven days, twenty eight days, twenty nine days, thirty days, thirty one days, thirty two days, thirty three days, thirty four days, thirty five days, thirty six days, thirty seven days, thirty eight days, thirty nine days, forty days, forty one days, forty two days, forty three days, forty four days, forty five days, forty six days, forty seven days, forty eight days, forty nine days, fifty days, fifty one days, fifty two days, fifty three days, fifty four days, fifty five days, fifty six days, fifty seven days, fifty eight days, fifty nine days, or sixty days or longer are sufficient for the cultured microspores to form MCS and/or ELS. Incubation or culturing periods for inducing embryogenesis are optimized based on the type and the concentration of the embryogenesis inducing agent based on the guidance provided in the present disclosure. The present disclosure also provides methods of generating microspore-derived doubled haploid populations, using the methods described herein to promote microspore embryogenesis from a tissue or organ of a filial plant resultant from a genetic cross of two different strains, such as a first generation $F_1$ hybrid or alternatively in later filial generations or back-cross generations, in a hemizygous transgenic condition.

The present disclosure provides methods of promoting microspore embryogenesis from a tissue or organ of a first generation $F_1$ hybrid derived from transforming an $F_1$ embryo per se into the $F_1$ hybrid regenerated directly in a hemizygous transgenic condition for the purpose of generating a microspore-derived doubled haploid population. In a further aspect, the generated and/or treated microspores and/or microspore-derived cells are brought into contact with a chromosome doubling agent to promote diploidization of the microspore-derived embryoids.

An embryogenesis factor can be used in combination with a morphogenic developmental gene involved in plant metabolism, organ development, stem cell development, cell growth stimulation, organogenesis, somatic embryogenesis initiation, accelerated somatic embryo maturation, initiation and/or development of the apical meristem, initiation and/or development of shoot meristem, or combinations thereof to improve cellular reprogramming. When embryogenesis factors are co-expressed with a morphogenic developmental gene improved methods for obtaining a plant are provided.

The present disclosure provides methods for improving cellular reprogramming and producing a transgenic event, comprising (a) infecting a plant cell with a bacterial strain containing a plasmid that comprises a transfer-DNA containing an embryogenesis factor gene and/or a morphogenic gene and (b) regenerating the transgenic event. The embryogenesis factor gene is selected from any of the embryogenesis factor genes disclosed herein. The morphogenic gene is selected from (i) a nucleotide sequence encoding a functional WUS/WOX polypeptide, or (ii) a nucleotide sequence encoding a Babyboom (BBM) polypeptide or an Ovule Development Protein 2 (ODP2) polypeptide, or (iii) a combination of (i) and (ii).

The present disclosure provides methods of promoting microspore embryogenesis in a cell, tissue or organ of a plant by contacting the cell, tissue or organ with an cellular reprogramming factor, including embryogenesis factors, capable of reprogramming the cell, tissue or organ wherein embryogenesis is induced in the cell, tissue or organ, such as, for example, an embryogenesis factor inducing an exogenous morphogenic developmental gene protein product and/or an embryogenesis inducing compound.

Also provided are methods of generating microspore-derived doubled haploid populations by ectopically expressing in a plant tissue or organ a fusion protein gene product of an embryogenesis inducing embryogenesis factor and a translocation signal fusion protein gene product and/or a fusion protein gene product of an embryogenesis inducing morphogenic developmental gene and a translocation signal fusion protein gene product enabling cellular reprogramming and embryogenic growth stimulation in non-transformed cells, and particularly in gametes or haploid cells during the development of the gametes or haploid cells. In another aspect, the disclosure provides methods for generating in a plant tissue or organ a microspore-derived doubled haploid population using an embryogenesis inducing embryogenesis factor gene operably linked to a translocation signal peptide and a fluorescent protein and/or an embryogenesis inducing morphogenic developmental gene operably linked to a translocation signal peptide and a fluorescent protein and selecting based on the presence or absence of the embryogenesis inducing embryogenesis factor gene/translocation signal peptide/fluorescent protein fusion and/or the morphogenic developmental gene/translocation signal peptide/fluorescent protein fusion enabling cellular reprogramming and embryogenic growth stimulation in non-transformed cells, and particularly in gametes or haploid cells during the development of the gametes or haploid cells. The present disclosure provides methods for reprogramming microspores by co-culturing microspores with a purified protein, such as an embryogenesis factor gene product and/or a morphogenic developmental gene embryogenesis inducing gene product. In another aspect, methods are provided for reprogramming microspores by co-culturing microspores in the presence of cells expressing an embryogenesis factor gene product and/or a morphogenic developmental gene embryogenesis inducing gene product.

The present disclosure provides methods for clonal propagation of plantlets derived from cells of a maternal haploid embryo produced by ectopic expression in a plant tissue or organ of an embryogenesis factor with or without a translocation signal peptide and/or a morphogenic developmental gene with or without a translocation signal. Also provided are methods for clonal propagation of multiple gene edited plantlets derived from cells of a maternal haploid embryo produced by ectopic expression in a plant tissue or organ of an embryogenesis factor with or without a translocation signal peptide and/or ectopic expression of a morphogenic developmental gene with or without a translocation signal peptide fused to a gene product of a nuclease gene with or without a translocation signal peptide.

The present disclosure also provides in maternally-derived haploid embryo cells methods of promoting embryogenesis in endosperm cells and gene editing using a transformed haploid inducer line expressing an embryogenesis inducing gene product of a embryogenesis factor with or without a translocation signal and a nuclease gene with or without a fertilization translocation signal peptide and/or a morphogenic developmental gene with or without a translocation signal peptide and a nuclease gene with or without a fertilization translocation signal peptide. In a further aspect, the treated maternal haploids embryos and/or embryo-derived cells are brought into contact with a chromosome doubling agent to promote diploidization and regeneration of the maternally-derived somatic embryos.

As used herein, the term "morphogenic gene" or "morphogenic developmental gene" means a gene that when ectopically expressed stimulates formation of a somatically-derived structure that can produce a plant. More precisely, ectopic expression of the morphogenic gene stimulates the de novo formation of a somatic embryo or an organogenic structure, such as a shoot meristem, that can produce a plant. This stimulated de novo formation occurs either in the cell in which the morphogenic gene is expressed, or in a neighboring cell. A morphogenic gene can be a transcription factor that regulates expression of other genes, or a gene that influences hormone levels in a plant tissue, both of which can stimulate morphogenic changes. A morphogenic gene may be stably incorporated into the genome of a plant or it may be transiently expressed. As used herein, the term "morphogenic factor" means a morphogenic gene and/or the protein expressed by a morphogenic gene.

Morphogenic genes involved in plant metabolism, organ development, stem cell development, cell growth stimulation, organogenesis, regeneration, somatic embryogenesis initiation, accelerated somatic embryo maturation, initiation and/or development of the apical meristem, initiation and/or development of shoot meristem, initiation and/or development of shoots, or a combination thereof, such as WUS/WOX genes (WUS1, WUS2, WUS3, WOX2A, WOX4, WOX5, or WOX9) see U.S. Pat. Nos. 7,348,468 and 7,256,322 and United States Patent Application publications 2017/0121722 and 2007/0271628; Laux et al. (1996) Development 122:87-96; and Mayer et al. (1998) Cell 95:805-815; van der Graaff et al., 2009, Genome Biology 10:248; Dolzblasz et al. 2016. Mol. Plant 19:1028-39 are useful in the methods of the disclosure. Modulation of WUS/WOX is expected to modulate plant and/or plant tissue phenotype including plant metabolism, organ development, stem cell development, cell growth stimulation, organogenesis, regeneration, somatic embryogenesis initiation, accelerated somatic embryo maturation, initiation and/or development of the apical meristem, initiation and/or development of shoot meristem, initiation and/or development of shoots, or a combination thereof. Expression of *Arabidopsis* WUS can induce stem cells in vegetative tissues, which can differentiate into somatic embryos (Zuo, et al. (2002) Plant J 30:349-359). Also of interest in this regard, would be a MYB 118 gene (see U.S. Pat. No. 7,148,402), a MYB 115 gene (see Wang et al. (2008) Cell Research 224-235), a BABYBOOM gene (BBM; see Boutilier et al. (2002) Plant Cell 14:1737-1749), or a CLAVATA gene (see, for example, U.S. Pat. No. 7,179,963). Morphogenic genes useful in the present disclosure include, but are not limited to, functional WUS/WOX genes.

Morphogenic polynucleotide sequences and amino acid sequences of WUS/WOX homeobox polypeptides are useful in the disclosed methods. As defined herein, a "functional WUS/WOX nucleotide" or a "functional WUS/WOX gene" is any polynucleotide encoding a protein that contains a homeobox DNA binding domain, a WUS box, and an EAR repressor domain (Ikeda et al., 2009 Plant Cell 21:3493-3505). As demonstrated by Rodriguez et al., 2016 PNAS removal of the dimerization sequence which leaves behind the homeobox DNA binding domain, a WUS box, and an EAR repressor domain results in a functional WUS/WOX polypeptide. The WUSCHEL protein, designated hereafter as WUS, plays a key role in the initiation and maintenance of the apical meristem, which contains a pool of pluripotent stem cells (Endrizzi et al., (1996) Plant Journal 10:967-979; Laux, et al., (1996) Development 122:87-96; and Mayer, et al., (1998) Cell 95:805-815). *Arabidopsis* plants mutant for the WUS gene contain stem cells that are misspecified and that appear to undergo differentiation. WUS encodes a homeodomain protein which presumably functions as a transcriptional regulator (Mayer, et al., (1998) Cell 95:805-815). The stem cell population of *Arabidopsis* shoot meristems is believed to be maintained by a regulatory loop between the CLAVATA (CLV) genes which promote organ initiation and the WUS gene which is required for stem cell identity, with the CLV genes repressing WUS at the transcript level, and WUS expression being sufficient to induce meristem cell identity and the expression of the stem cell marker CLV3 (Brand, et al., (2000) Science 289:617-619; Schoof, et al., (2000) Cell 100:635-644). Constitutive expression of WUS in *Arabidopsis* has been shown to lead to adventitious shoot proliferation from leaves (in planta) (Laux, T., Talk Presented at the XVI International Botanical Congress Meeting, Aug. 1-7, 1999, St. Louis, Mo.).

In an aspect, the functional WUS/WOX homeobox polypeptide useful in the methods of the disclosure is a WUS, WUS2, WUS3, WOX2A, WOX4, WOX5, WOX5A, or WOX9 polypeptide (see, U.S. Pat. Nos. 7,348,468 and 7,256,322 and US Patent Application Publication Numbers 2017/0121722 and 2007/0271628, herein incorporated by reference in their entirety and van der Graaffeta., 2009, Genome Biology 10:248). The functional WUS/WOX homeobox polypeptide useful in the methods of the disclosure can be obtained from or derived from any plant. Functional WUS/WOX nucleotides encoding proteins that contain a homeobox DNA binding domain, a WUS box, and an EAR repressor domain useful in the methods of the disclosure are listed in Table 1 below.

TABLE 1

| SEQ ID NO: | Polynucleotide (DNA) or Polypeptide (PRT) | Name | Description |
|---|---|---|---|
| 246 | DNA | AT-WUS | Arabidopsis thaliana WUS coding sequence |
| 247 | PRT | AT-WUS | Arabidopsis thaliana WUS protein sequence |
| 248 | DNA | LJ-WUS | Lotus japonicus WUS coding sequence |
| 249 | PRT | LJ-WUS | Lotus japonicus WUS protein sequence |
| 250 | DNA | GM-WUS | Glycine max WUS coding sequence |
| 251 | PRT | GM-WUS | Glycine max WUS protein sequence |
| 252 | DNA | CS-WUS | Camelina sativa WUS coding sequence |
| 253 | PRT | CS-WUS | Camelina sativa WUS protein sequence |
| 254 | DNA | CR-WUS | Capsella rubella WUS coding sequence |
| 255 | PRT | CR-WUS | Capsella rubella WUS protein sequence |
| 256 | DNA | AA-WUS | Arabis alpina WUS coding sequence |
| 257 | PRT | AA-WUS | Arabis alpina WUS protein sequence |
| 258 | DNA | RS-WUS | Raphanus sativus WUS coding sequence |
| 259 | PRT | RS-WUS | Raphanus sativus WUS protein sequence |
| 260 | DNA | BN-WUS | Brassica napus WUS coding sequence |
| 261 | PRT | BN-WUS | Brassica napus WUS protein sequence |
| 262 | DNA | BO-WUS | *Brassica oleracea* var. *oleracea* WUS coding sequence |
| 263 | PRT | BO-WUS | *Brassica oleracea* var. *oleracea* WUS protein sequence |
| 264 | DNA | HA-WUS | Helianthus annuus WUS coding sequence |
| 265 | PRT | HA-WUS | Helianthus annuus WUS protein sequence |
| 266 | DNA | PT-WUS | Populus trichocarpa WUS coding sequence |
| 267 | PRT | PT-WUS | Populus trichocarpa WUS protein sequence |
| 268 | DNA | W-WUS | Vitus vinifera WUS coding sequence |
| 269 | PRT | W-WUS | Vitus vinifera WUS protein sequence |
| 270 | DNA | AT-WUS | Arabidopsis thaliana WUS coding sequence (soy optimized) |
| 271 | PRT | AT-WUS | Arabidopsis thaliana WUS protein sequence |
| 272 | DNA | LJ-WUS | Lotus japonicus WUS coding sequence (soy optimized) |
| 273 | PRT | LJ-WUS | Lotus japonicus WUS protein sequence |
| 274 | DNA | MT-WUS | Medicago truncatula WUS coding sequence (soy optimized) |
| 275 | PRT | MT-WUS | Medicago truncatula WUS protein sequence |

TABLE 1-continued

| SEQ ID NO: | Polynucleotide (DNA) or Polypeptide (PRT) | Name | Description |
|---|---|---|---|
| 276 | DNA | PY-WUS | Petunia hybrida WUS coding sequence (soy optimized) |
| 277 | PRT | PY-WUS | Petunia hybrida WUS protein sequence |
| 278 | DNA | PV-WUS | Phaseolus vulgaris WUS coding sequence (soy optimized) |
| 279 | PRT | PV-WUS | Phaseolus vulgaris WUS protein sequence |
| 280 | DNA | ZM-WUS1 | Zea mays WUS1 coding sequence |
| 281 | PRT | ZM-WUS1 | Zea mays WUS1 protein sequence |
| 282 | DNA | ZM-WUS2 | Zea mays WUS2 coding sequence |
| 283 | PRT | ZM-WUS2 | Zea mays WUS2 protein sequence |
| 284 | DNA | ZM-WUS3 | Zea mays WUS3 coding sequence |
| 285 | PRT | ZM-WUS3 | Zea mays WUS3 protein sequence |
| 286 | DNA | ZM-WOX2A | Zea mays WOX2A coding sequence |
| 287 | PRT | ZM-WOX2A | Zea mays WOX2A protein sequence |
| 288 | DNA | ZM-WOX4 | Zea mays WOX4 coding sequence |
| 289 | PRT | ZM-WOX4 | Zea mays WOX4 protein sequence |
| 290 | DNA | ZM-WOX5A | Zea mays WOX5 A coding sequence |
| 291 | PRT | ZM-WOX5A | Zea mays WOX5 A protein sequence |
| 292 | DNA | ZM-WOX9 | Zea mays WOX9 coding sequence |
| 293 | PRT | ZM-WOX9 | Zea mays WOX9 protein sequence |
| 294 | DNA | GG-WUS | Gnetum gnemon WUS coding sequence |
| 295 | PRT | GG-WUS | Gnetum gnemon WUS protein sequence |
| 296 | DNA | MD-WUS | Malus domestica WUS coding sequence |
| 297 | PRT | MD-WUS | Malus domestica WUS protein sequence |
| 298 | DNA | ME-WUS | Manihot esculenta WUS coding sequence |
| 299 | PRT | ME-WUS | Manihot esculenta WUS protein sequence |
| 300 | DNA | KF-WUS | Kalanchoe fedtschenkoi WUS coding sequence |
| 301 | PRT | KF-WUS | Kalanchoe fedtschenkoi WUS protein sequence |
| 302 | DNA | GH-WUS | Gossypium hirsutum WUS coding sequence |
| 303 | PRT | GH-WUS | Gossypium hirsutum WUS protein sequence |
| 304 | DNA | ZOSMA-WUS | Zostera marina WUS coding sequence |
| 305 | PRT | ZOSMA-WUS | Zostera marina WUS protein sequence |
| 306 | DNA | AMBTR-WUS | Amborella trichopoda WUS coding sequence |
| 307 | PRT | AMBTR-WUS | Amborella trichopoda WUS protein sequence |
| 308 | DNA | AC-WUS | Aquilegia coerulea WUS coding sequence |
| 309 | PRT | AC-WUS | Aquilegia coerulea WUS protein sequence |
| 310 | DNA | AH-WUS | Amaranthus hypochondriacus WUS coding sequence |
| 311 | PRT | AH-WUS | Amaranthus hypochondriacus WUS protein sequence |
| 312 | DNA | CUCSA-WUS | Cucumis sativus WUS coding sequence |
| 313 | PRT | CUCSA-WUS | Cucumis sativus WUS protein sequence |
| 314 | DNA | PINTA-WUS | Pinus taeda WUS coding sequence |
| 315 | PRT | PINTA-WUS | Pinus taeda WUS protein sequence |

Other morphogenic genes useful in the present disclosure include, but are not limited to, LEC1 (U.S. Pat. No. 6,825,397 incorporated herein by reference in its entirety, Lotan et al., 1998, Cell 93:1195-1205), LEC2 (Stone et al., 2008, PNAS 105:3151-3156; Belide et al., 2013, Plant Cell Tiss. Organ Cult 113:543-553), KN1/STM (Sinha et al., 1993. Genes Dev 7:787-795), the IPT gene from *Agrobacterium* (Ebinuma and Komamine, 2001, In vitro Cell. Dev Biol—Plant 37:103-113), MONOPTERO S-DELTA (Ckurshumova et al., 2014, New Phytol. 204:556-566), the *Agrobacterium* AV-6b gene (Wabiko and Minemura 1996, Plant Physiol. 112:939-951), the combination of the *Agrobacterium* IAA-h and IAA-m genes (Endo et al., 2002, Plant Cell Rep., 20:923-928), the *Arabidopsis* SERK gene (Hecht et al., 2001, Plant Physiol. 127:803-816), the *Arabidopsis* AGL15 gene (Harding et al., 2003, Plant Physiol. 133:653-663), the FUSCA gene (Castle and Meinke, Plant Cell 6:25-41), and the PICKLE gene (Ogas et al., 1999, PNAS 96:13839-13844).

The present disclosure also includes plants obtained by any of the disclosed methods or compositions herein. The present disclosure also includes seeds from a plant obtained by any of the methods or compositions disclosed herein. As used herein, the term "plant" refers to whole plants, plant organs (e.g., leaves, stems, roots, etc.), plant tissues, plant cells, plant parts, seeds, propagules, embryos and progeny of the same. As used herein, the term "plant" refers to whole plants, plant organs (e.g., leaves, stems, roots, etc.), plant tissues, plant cells, plant parts, seeds, propagules, embryos and progeny of the same. Plant cells can be differentiated or undifferentiated (e.g. callus, undifferentiated callus, immature and mature embryos, immature zygotic embryo, immature cotyledon, embryonic axis, suspension culture cells, protoplasts, leaf, leaf cells, root cells, phloem cells and pollen). Plant cells include, without limitation, cells from seeds, suspension cultures, explants, immature embryos, embryos, zygotic embryos, somatic embryos, embryogenic callus, meristem, somatic meristems, organogenic callus, protoplasts, embryos derived from mature ear-derived seed, leaf bases, leaves from mature plants, leaf tips, immature inflorescences, tassel, immature ear, silks, cotyledons, immature cotyledons, meristematic regions, callus tissue, cells from leaves, cells from stems, cells from roots, cells from shoots, gametophytes, sporophytes, pollen, microspores, multicellular structures (MCS), and embryo-like structures (ELS). Plant parts include differentiated and undifferentiated tissues including, but not limited to, roots, stems, shoots, leaves, pollen, seeds, tumor tissue and various forms of cells in culture (e. g., single cells, protoplasts, embryos, and callus tissue). The plant tissue may be in a plant or in a plant organ, tissue, or cell culture. Grain is intended to mean the mature seed produced by commercial growers for purposes other than growing or reproducing the species. Progeny, variants and mutants of the regenerated plants are also included within the scope of the disclosure, provided these progeny, variants and mutants are derived from regenerated plants made using the methods and compositions disclosed herein and/or comprise the introduced polynucleotides disclosed herein.

As used herein, the terms "transformed plant" and "transgenic plant" refer to a plant that comprises within its genome a heterologous polynucleotide. Generally, the heterologous polynucleotide is stably integrated within the genome of a transgenic or transformed plant such that the polynucleotide is passed on to successive generations. The heterologous polynucleotide may be integrated into the genome alone or as part of a recombinant DNA construct. It is to be understood that as used herein the term "transgenic" includes any cell, cell line, callus, tissue, plant part or plant the genotype of which has been altered by the presence of a heterologous nucleic acid including those transgenics initially so altered as well as those created by sexual crosses or asexual propagation from the initial transgenic. A transgenic plant is defined as a mature, fertile plant that contains a transgene.

A transgenic "event" is produced by transformation of plant cells with a heterologous DNA construct, including a nucleic acid expression cassette that comprises a gene of interest, the regeneration of a population of plants resulting from the insertion of the transferred gene into the genome of the plant and selection of a plant characterized by insertion into a particular genome location. An event is characterized phenotypically by the expression of the inserted gene. At the genetic level, an event is part of the genetic makeup of a plant. The term "event" also refers to progeny produced by a sexual cross between the transformant and another plant wherein the progeny include the heterologous DNA.

The compositions and methods of the present disclosure are applicable to a broad range of plant species, including dicotyledonous plants and monocotyledonous plants. Representative examples of plants that can be treated in accordance with the methods disclosed herein include, but are not limited to, wheat, cotton, sunflower, safflower, tobacco, *Arabidopsis*, barley, oats, rice, maize, triticale, sorghum, rye, millet, flax, sugarcane, banana, cassava, common bean, cowpea, tomato, potato, beet, grape, *Eucalyptus*, wheat grasses, turf grasses, alfalfa, clover, soybean, peanuts, citrus, papaya, *Setaria* sp, cacao, cucumber, apple, *Capsicum*, bamboo, melon, ornamentals including commercial garden and flower bulb species, fruit trees, vegetable species, *Brassica* species, as well as interspecies hybrids. In a preferred embodiment, the compositions and methods of the disclosure are applied to maize plants.

The methods of the disclosure involve introducing a polypeptide, polynucleotide (i.e., DNA or RNA), or nucleotide construct (i.e., DNA or RNA) into a plant. As used herein, "introducing" means presenting to the plant the polynucleotide, polypeptide, or nucleotide construct in such a manner that the polynucleotide, polypeptide, or nucleotide construct gains access to the interior of a cell of the plant. The methods of the disclosure do not depend on a particular method for introducing the polynucleotide, polypeptide, or nucleotide construct into a plant, only that the polynucleotide, polypeptide, or nucleotide construct gains access to the interior of at least one cell of the plant. Methods for introducing polynucleotides, polypeptides, or nucleotide constructs into plants are known in the art including, but not limited to, stable transformation methods, transient transformation methods and virus-mediated methods.

As used herein, a "stable transformation" is a transformation in which the polynucleotide or nucleotide construct introduced into a plant integrates into the genome of the plant and is capable of being inherited by the progeny thereof. "Transient transformation" means that a polynucleotide or nucleotide construct is introduced into the plant and does not integrate into the genome of the plant or a polypeptide is introduced into a plant. In addition, "transient", in certain embodiments may represent the presence of an embryogenesis inducing agent in a cell where such an agent has been exogenously applied or secreted from a neighboring cell or is being produced from an extrachromosomal location (e.g., plasmid or another independently replicating origin), or not produced by a stably integrated recombinant DNA construct within the same cell.

As used herein, "contacting", "comes in contact with" or "in contact with" mean "direct contact" or "indirect contact". For example, cells are placed in a condition where the cells can come into contact with any of the embryogenesis inducing substances disclosed herein including, but not limited to, an embryogenesis inducing embryogenesis factor, a morphogenic developmental gene, a small molecule or a doubling agent. Such substance is allowed to be present in an environment where the cells survive (for example, medium or expressed in the cell or expressed in an adjacent cell) and can act on the cells. For example, the medium comprising a doubling agent may have direct contact with the haploid cell or the medium comprising the doubling agent may be separated from the haploid cell by filter paper, plant tissues, or other cells thus the doubling agent is transferred through the filter paper or cells to the haploid cell.

As used herein, the term "biparental cross" is the cross-fertilization of two genetically different plants to obtain the first filial generation of offspring and/or any successive filial generation thereafter. As used herein a biparental cross includes the offspring that are the progeny of any filial generation of offspring, including cross-fertilizing an offspring to one of its parental lines or an individual genetically like its parent to obtain progeny with a genetic identity closer to that of the parent referred to as a "backcross" and/or any successive backcross generation thereafter.

The methods provided herein rely upon the use of bacteria-mediated and/or biolistic-mediated gene transfer to produce regenerable plant cells. Bacterial strains useful in the methods of the disclosure include, but are not limited to, a disarmed Agrobacteria, an *Ochrobactrum* bacteria or a Rhizobiaceae bacteria (U.S. Pat. No. 9,365,859 incorporated herein by reference in its entirety). Standard protocols for particle bombardment (Finer and McMullen, 1991, In Vitro Cell Dev. Biol. —Plant 27:175-182), *Agrobacterium*-mediated transformation (Jia et al., 2015, Int J. Mol. Sci. 16:18552-18543; US2017/0121722 incorporated herein by reference in its entirety), or *Ochrobactrum*-mediated transformation (US2018/0216123 incorporated herein by reference in its entirety) can be used with the methods and compositions of the disclosure. Numerous methods for introducing heterologous genes into plants are known and can be used to insert a polynucleotide into a plant host, including biological and physical plant transformation protocols. See, e.g., Miki et al., "Procedure for Introducing Foreign DNA into Plants," in Methods in Plant Molecular Biology and Biotechnology, Glick and Thompson, eds., CRC Press, Inc., Boca Raton, pp. 67-88 (1993). The methods chosen vary with the host plant and include chemical transfection methods such as calcium phosphate, microorganism-mediated gene transfer such as *Agrobacterium* (Horsch, et al., (1985) Science 227:1229-31), *Ochrobactrum* (US2018/0216123), electroporation, micro-injection and biolistic bombardment. Expression cassettes and vectors and in vitro culture methods for plant cell or tissue transformation and regeneration of transgenic plants are known and available. See, e.g., Gruber, et al., "Vectors for Plant Transformation," in Methods in Plant Molecular Biology and Biotechnology, supra, pp. 89-119.

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (Townsend, et al., U.S. Pat. No. 5,563,055 and Zhao, et al., U.S. Pat. No. 5,981,840), Ochrobactrum-mediated transformation (US2018/0216123), direct gene transfer (Paszkowski, et al., (1984) *EMBO J.* 3:2717-2722) and ballistic particle acceleration (see, for example, U.S. Pat. Nos. 4,945,050; 5,879,918; 5,886,244; 5,932,782; Tomes, et al., (1995) in Plant Cell, Tissue, and Organ Culture: Fundamental Methods, ed. Gamborg and Phillips (Springer-Verlag, Berlin); McCabe, et al., (1988) *Biotechnology* 6:923-926) and Lec1 transformation (WO 00/28058). See also, Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in The Experimental Manipulation of Ovule Tissues, ed. Chapman, et al., (Longman, New York), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Ishida, et al., (1996) *Nature Biotechnology* 14:745-750 (maize via *Agrobacterium tumefaciens*), all of which are herein incorporated by reference in their entirety. Methods and compositions for rapid plant transformation are also found in U.S. 2017/0121722, herein incorporated in its entirety by reference. Vectors useful in plant transformation are found in U.S. patent application Ser. No. 15/765,521, herein incorporated by reference in its entirety.

Methods for harvesting tassels, including sterilization methods, as well as tassel pretreatments, for example, temperature pretreatments, are known in the art and will vary depending on the intended tassel use. Specifically, prior to selecting tassels for microspore culture, microspores must be staged to an appropriate stage typically, between the uninucleate to binucleate stage. Typically, for tassels with anthers and microspores at the appropriate stage, the tassels were detached, and each tassel was individually wrapped in for example, aluminum foil.

Isolation of microspores typically occurs after a tassel pretreatment in a reduced temperature environment to improve the androgenic response. A commonly used technique is to place foil wrapped tassels at 10° C. for between 1 to 21 days. Additionally, preculture of anthers in a mannitol solution, for example 0.3M liquid mannitol plus 50 mg/L ascorbic acid, can be practiced (U.S. Pat. Nos. 5,322,789 and 5,445,961 incorporated herein by reference in their entireties).

Prior to use, tassels can be surface-sterilized in a 40% Clorox (8.25% Sodium Hypochlorite diluted v/v) solution with two drops of Tween 80 for approximately fifteen minutes, with gentle agitation on a reciprocal shaker. The tassels are then rinsed three or more times in sterile water at room temperature and placed in a large petri dish and typically left uncovered for 1-1.5 hours under aseptic conditions to allow any excess water to evaporate prior to microspore isolation. Another method of surface sterilization includes placing spikelets detached from the tassel into permeable baskets that are then submerged in a 40% Clorox (8.25% Sodium Hypochlorite diluted v/v) solution with two drops of Tween 80 for fifteen minutes followed by rinsing as described above. The spikelets are placed in a large petri dish and typically left uncovered for 1-1.5 hours to allow excess water to evaporate prior to microspore isolation.

Isolation procedures for maize anthers and spikelets include, but not limited to, glass rod maceration methods (Pescitelli, et al., (1990) Plant Cell Rep. 8:628-31), blending methods, razor blade tissue cutting methods (see U.S. Pat. No. 5,445,961 incorporated herein by reference in its entirety), tissue homogenizer methods (Gaillard, et al., (1991) Plant Cell Rep. 10:55-8), and tissue grinder methods (Mandaron et al., (1990) Theor Appl Genet 80: 134-138).

Following isolation of microspores from the surrounding somatic tissue, the microspores are typically immediately after separation from any anther debris placed into a fresh isolation medium. Numerous media compositions are known in the art. A common method of separating microspores from anther debris is to pass a blended microspore anther debris slurry from the isolation procedure through a sieve (Pescitelli (1989) Plant Cell Rep. 7:673-6, Gaillard, et al., (1991), and U.S. Pat. No. 5,445,961 incorporated herein by reference in its entirety). Alternatively, the microspore anther debris slurry is passed through several layers of cheesecloth or a mesh filter (Coumans, (1989) Plant Cell Rep. 7:618-21). Further separation can be performed using a discontinuous density centrifugation method or additional filtration methods, including but not limited, to methods using a sucrose or Percoll gradient (Coumans, (1989), Pescitelli et al., (1990)). Alternatively, selection of cells captured at the 20-30% interface of a Percoll gradient ranging from 20-50% after centrifugation at 225 g for 3 min can be further separated using a final, high sucrose (0.44M) centrifugation method (Gaillard, et al., (1991)). Further variations to separation methods are known in the art (Vergne et al., (1991) In: Negrutiu I. (ed) BioMethods. Birkhauser, Basel, Boston, Bedinger and Edgerton, (1990) Plant Physiol. 92:474-9, Gaillard, et al., (1991)) and can be optimized as needed.

Specific media used during isolation, for example, typically consists of 6% sucrose, 50 mg/L acorbic acid, 400 mg/L proline, 0.05 mg/L biotin and 10 mg/L nicotinic acid (see Petolino and Genovesi (1994) The Maize Handbook, Freeling, M., Walbot, V. (eds) Springer-Verlag, New York). Various other media and solutions used for the culturing of maize microspores are similar to those used for other cereal tissue culture procedures and various modifications can be used (see Genovesi and Magill, (1982) Plant Cell Rep. 1:257-60, Martin and Widholm, (1996) Plant Cell Rep. 15:781-85, Magnard et al., (2000) Plant Mol Biol 44:559-74, Testillano et al., (2002) Int J Dev Biol 46:1035-47, Testillano et al., (2004) Chromosoma 112:342-9, Shariatpanahi et al., (2006) Plant Cell Rep 25:1294-9, Shim et al., (2006) Protoplasma 228:79-86, Soriano et al., (2008) Plant Cell Rep 27:805-11, Cistue et al., (2009) Plant Cell Rep 28:727-35, Jacquard et al., (2009) Planta 229:393-402, Jacquard et al., (2009) Plant Cell Rep 28:1329-39, Shim et al., (2009) Genome 52:166-74, Sanchez-Diaz et al., (2013) Plant Reprod 26: 287-96). Common features for maize culture media typically include the use of N6, NLN, or YP basal salt formulations with relatively high sugar concentrations (6-12%) that may have constituents including triiodobenzoic acid, various phytohormones, and/or proline.

The compositions and methods of the present disclosure include producing doubled haploid plants from gametes by contacting a plant cell with an embryogenesis factor gene product and/or a morphogenic developmental gene embryogenesis inducing gene product that can induce cellular reprogramming and activate embryogenesis within the cell. An ex situ cellular reprogramming method is provided for androgenic induction by contacting isolated microspores with an embryogenesis factor gene product and/or a morphogenic developmental gene embryogenesis inducing gene product.

Optionally, the ex situ methods of the present disclosure use isolated microspores co-cultured with suspension "feeder cells" expressing an embryogenesis factor gene product and/or a morphogenic gene product to further promote cellular reprogramming to activate microspore embryogenesis.

Optionally, the ex situ cellular reprogramming methods of the present disclosure can be combined with and used with microspores isolated from plant tissues generated using an in planta cellular reprogramming method disclosed herein.

The present disclosure provides an in planta cellular reprogramming method for regenerating maternal haploid embryos by transforming a maize haploid inducer line to stably integrate and express a heterologous expression cassette encoding a morphogenic developmental polypeptide that stimulates somatic embryogenesis and also encoding a second component including genes useful for gene editing purposes. Both components may comprise fusion peptides using secretion signal peptides operably linked to a promoter expressed within the endosperm. Reporter genes or selectable marker genes may also be included in the expression cassettes of the present disclosure. Examples of suitable reporter genes known in the art can be found in, for example, Jefferson, et al., (1991) in Plant Molecular Biology Manual, ed. Gelvin, et al., (Kluwer Academic Publishers), pp. 1-33; DeWet, et al., (1987) *Mol. Cell. Biol.* 7:725-737; Goff, et al., (1990) *EMBO J.* 9:2517-2522; Kain, et al., (1995) *Bio Techniques* 19:650-655 and Chiu, et al., (1996) *Current Biology* 6:325-330, herein incorporated by reference in their entirety.

Selectable marker genes for selection of transformed cells or tissues can include genes that confer antibiotic resistance or resistance to herbicides. Examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213; Meijer, et al., (1991) *Plant Mol. Biol.* 16:807-820); hygromycin (Waldron, et al., (1985) *Plant Mol. Biol.* 5:103-108 and Zhijian, et al., (1995) *Plant Science* 108:219-227); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-36); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518), herein incorporated by reference in their entirety.

Other genes may be used the expression cassettes of the present disclosure that also assist in the recovery of transgenic events and include, but are not limited to, GUS (beta-glucuronidase; Jefferson, (1987) *Plant Mol. Biol.* Rep. 5:387), GFP (green fluorescence protein; Chalfie, et al., (1994) *Science* 263:802), luciferase (Riggs, et al., (1987) *Nucleic Acids Res.* 15(19):8115 and Luehrsen, et al., (1992) *Methods Enzymol.* 216:397-414) and the maize genes encoding for anthocyanin production (Ludwig, et al., (1990) *Science* 247:449), herein incorporated by reference in their entirety.

The methods of the disclosure also provide for expression of a first component comprising multiple embryogenesis factor genes and/or morphogenic genes in one expression cassette operably linked to a promoter and a second component including genes useful for gene editing purposes, including, but not limited to, a *Streptococcus pyogenes* (CRISPR) CAS9 or other nuclease proteins, including, but not limited to, zinc finger nucleases, meganucleases, or transcription activator-like effector nucleases. The use of the first component in a transformed maize haploid inducer line for fertilizing the maternal ear of a target plant is useful for improving doubled haploid production while the second component enables improving the regeneration of geneedited, maize doubled haploids.

The present disclosure also provides methods of contacting haploid cells with an amount of a chromosome doubling agent before, during, after, or overlapping with any portion of the isolation and embryogenesis induction process used for generating a paternal gamete (androgenic) or a maternal gamete (gynogenic) doubled haploid population.

The use of a cellular reprogramming agent (an embryogenesis inducing polypeptide or an embryogenesis inducing compound) or a cellular reprogramming treatment of a plant cell outside of the tissue of the organism, for example, extracted cells that have been isolated for experimentation and/or measurement done in an external environment, is referred to as an "ex situ" treatment or treatment method.

As used herein "recombinant" means a cell or vector, that has been modified by the introduction of a heterologous nucleic acid or a cell derived from a cell so modified. Thus, for example, a recombinant cell is a cell expressing a gene that is not found in identical form or location within the native (non-recombinant) cell or a cell that expresses a native gene in an expression pattern that is different from that of the native (non-recombinant) cell for example, the native gene is abnormally expressed, under expressed, has reduced expression or is not expressed at all because of deliberate human intervention. The term "recombinant" as used herein does not encompass the alteration of a cell or vector by naturally occurring events (e.g., spontaneous mutation, natural transformation/transduction/transposition) such as those occurring without deliberate human intervention.

As used herein, a "recombinant expression cassette" is a nucleic acid construct, generated recombinantly or synthetically, with a series of specified nucleic acid elements, which permit transcription of a particular nucleic acid in a target cell. The recombinant expression cassette can be incorporated into a plasmid, chromosome, mitochondrial DNA, plastid DNA, virus or nucleic acid fragment. Typically, the recombinant expression cassette portion of an expression vector includes, among other sequences, a nucleic acid to be transcribed and a promoter.

The terms "polypeptide," "peptide" and "protein" are used interchangeably herein to refer to a polymer of amino acid residues. The terms apply to amino acid polymers in which one or more amino acid residue is an artificial chemical analogue of a corresponding naturally occurring amino acid, as well as to naturally occurring amino acid polymers.

As used herein, the polypeptides useful in the methods of the disclosure can be further engineered with a cell penetrating peptide, herein referred to as a "CPP". CPPs useful in the present methods are a class of short peptides with a property to translocate across cell membranes and act as nanocarriers for protein delivery into plant cells. Exemplary CPP families include, but are not limited to, CPPs derived from protein transduction domains, amphipathic peptides, and synthetic cationic polypeptides, such as polylysine, polyhistidine, and polyarginine, or dendrimeric polycationic molecules. Exemplary CPPs useful in the methods of the disclosure include, but are not limited to, the peptide vascular endothelial-cadherin CPP, the transportan CPP, the monomer and dimer of HIV-1 TAT basic domain CPP, the penetratin CPP, synthetic cationic homoarginine oligopeptide CPPs (see Eudes and Chugh. (2008) Plant Signal Behav. 3:549-550) and the gamma zein CPP (see U.S. Pat. No. 8,581,036, incorporated herein by reference in its entirety). The present disclosure provides methods of using a gamma-zein CPP morphogenic developmental protein translational fusion protein for use in contacting the gamma-zein linked structure with a plant cell and allowing uptake of the gamma-zein linked structure into the plant cell to alter cell fate of the plant cell.

The term "regulatory element" refers to a nucleic acid molecule having gene regulatory activity, i.e. one that has the ability to affect the transcriptional and/or translational expression pattern of an operably linked transcribable polynucleotide. The term "gene regulatory activity" thus refers to the ability to affect the expression of an operably linked transcribable polynucleotide molecule by affecting the transcription and/or translation of that operably linked transcribable polynucleotide molecule. Gene regulatory activity may be positive and/or negative and the effect may be characterized by its temporal, spatial, developmental, tissue, environmental, physiological, pathological, cell cycle, and/or chemically responsive qualities as well as by quantitative or qualitative indications.

Cis regulatory elements are regulatory elements that affect gene expression. Cis regulatory elements are regions of non-coding DNA that regulate the transcription of neighboring genes, often as DNA sequences in the vicinity of the genes that they regulate. Cis regulatory elements typically regulate gene transcription by encoding DNA sequences conferring transcription factor binding.

As used herein "promoter" is an exemplary regulatory element and generally refers to a nucleotide sequence capable of controlling the expression of a coding sequence or functional RNA. In general, a coding sequence is located 3' to a promoter sequence. The promoter sequence comprises proximal and more distal upstream elements, the latter elements are often referred to as enhancers. Accordingly, an "enhancer" is a nucleotide sequence that can stimulate promoter activity and may be an innate element of the promoter or a heterologous element inserted to enhance the level or tissue-specificity of a promoter. Promoters may be derived in their entirety from a native gene or may be composed of different elements derived from different promoters found in nature, or even comprise synthetic nucleotide segments. It is understood by those skilled in the art that different regulatory elements may direct the expression of a gene in different tissues or cell types, or at different stages of development, or in response to different environmental conditions.

A "plant promoter" is a promoter capable of initiating transcription in plant cells. Exemplary plant promoters include, but are not limited to, those that are obtained from plants, plant viruses, and bacteria such as *Agrobacterium* or *Rhizobium*, which comprise genes expressed in plant cells. Examples are promoters that preferentially initiate transcription in certain tissues, such as leaves, roots, seeds, fibers, xylem vessels, tracheids or sclerenchyma. Such promoters are referred to as "tissue preferred" promoters. A "cell type" specific promoter primarily drives expression in certain cell types in one or more organs, for example, vascular cells in roots or leaves. An "inducible" or "regulatable" promoter is a promoter which is under environmental control. Examples of environmental conditions that may affect transcription by inducible promoters include anaerobic conditions or the presence of light. Another type of promoter is a developmentally regulated promoter, for example, a promoter that drives expression during pollen development. Tissue preferred, cell type specific, developmentally regulated and inducible promoters are members of the class of "non-constitutive" promoters. A "constitutive" promoter is a promoter that causes a nucleic acid fragment to be expressed in most cell types at most times under most environmental conditions and states of development or cell differentiation.

A "translation leader sequence" refers to a nucleotide sequence located between the promoter sequence of a gene and the coding sequence. The translation leader sequence is present in the fully processed mRNA upstream of the translation start sequence. The translation leader sequence may affect numerous parameters including, processing of the primary transcript to mRNA, mRNA stability and/or translation efficiency. Examples of translation leader sequences have been described (Turner and Foster (1995) Mol. Biotechnol. 3:225-236).

Promoters useful in the methods of the present disclosure include those that modulate paternal and/or maternal embryogenesis. For paternal embryogenesis, exemplary promoters include tassel-preferred promoters, anther-preferred promoters, and tapetum-preferred promoters. Tissue-specific, tissue-preferred or stage-specific regulatory elements further include the anther-specific LAT52 (Twell, et al., (1989) Mol. Gen. Genet. 217:240-245), microspore-specific promoters such as the apg gene promoter (Twell, et al., (1993) Sex. Plant Reprod. 6:217-224), tapetum-specific promoters such as the TA29 gene promoter (Mariani, et al., (1990) Nature 347:737; U.S. Pat. No. 6,372,967), stamen-specific promoters such as the MS26 gene promoter, MS44 gene promoter, MS45 gene promoter, the 5126 gene promoter, the BS7 gene promoter, the PG47 gene promoter (U.S. Pat. Nos. 5,412,085; 5,545,546; Zheng et al., (1993) Plant J 3(2):261-271), the SGB6 gene promoter (U.S. Pat. No. 5,470,359), G9 gene promoter (U.S. Pat. No. 5,8937, 850; U.S. Pat. No. 5,589,610), the SB200 gene promoter (WO 2002/26789), and the like. A tissue-preferred promoter active in cells of male reproductive organs is particularly useful in the methods of the present disclosure.

For maternal embryogenesis, exemplary promoters include seed-preferred promoters. "Seed-preferred" promoters include both "seed-specific" promoters promoters that are active during seed development such as, promoters of seed storage proteins as well as "seed-germinating" promoters promoters that are active during seed germination (see Thompson et al. (1989) BioEssays 10:108, herein incorporated by reference). Seed-preferred promoters include, but are not limited to, the Cim1 (cytokinin-induced message) promoter; the cZ19B1 (maize 19 kDa zein) promoter; and the milps (myo-inositol-1-phosphate synthase) promoter (see WO 00/11177 and U.S. Pat. No. 6,225,529 incorporated herein by reference in their entireties). Other promoters useful in the methods of the disclosure include, but are not limited to, endosperm-specific promoters, such as the Gamma-zein promoter (Boronat et al. (1986) Plant Science 47:95-102) and embryo-specific promoters, such as the Globulin-1 (Glob-1) promoter. For monocots, seed-specific promoters include, but are not limited to, the maize 15 kDa promoter, ther 22 kDa zein promoter, the 27 kDa zein promoter, the gamma-zein promoter, the waxy promoter, the shrunken 1 promoter, the shrunken 2 promoter, the globulin 1 promoter, and the like. Seed-preferred promoters from the end1 and end2 genes (see WO 00/12733) are useful in the methods of the present disclosure. Additional seed-preferred promoters useful in the methods of the present disclosure include the oleosin promoter (WO 00/0028058), the lipid transfer protein (LTP) promoter (U.S. Pat. No. 5,525,716), the Lec1 promoter, the Jip1 promoter, and the milps3 promoter (see WO 02/42424).

As used herein, a "signal peptide" or "secretion signal peptide" sequence refers to a region of a protein interacting with a protein transport system and translocates or targets a protein for delivery to a particular destination. Examples of signal peptides or secretion signal peptides useful in the methods of the disclosure include, but are not limited to, signal-peptides targeting proteins to the extracellular matrix of the plant cell, such as the *Nicotiana plumbaginifolia* extension gene signal peptide (DeLoose, et al., (1991) Gene 99:95-100); signal peptides which cause proteins to be secreted, such as the PRIb signal peptide (Lind, et al., (1992) Plant Mol. Biol. 18:47-53) or the barley alpha amylase (BAA) signal peptide (Rahmatullah, et al., (1989) Plant Mol. Biol. 12:119).

Secretion signal peptides useful in the methods of the disclosure include those containing domains found in the superfamily of bifunctional inhibitor/plant lipid transfer protein/seed storage helical domain proteins that characteristically encode eight conserved cysteine residues important for secondary structure including, but are not limited to, lipid transfer proteins such as LILY-LIM2 (Q43534), Sorghum (XP_002445754), Barley (BAK05897), Rice-OSC4 (BAD09233), Rice-MEN-8 (XP_006660357), and Maize-MZm3-3 (NP_001105123) which are useful for engineering male-expressed plant-specific proteins. Secretion signal-peptides targeting proteins from the endosperm to the embryo are useful for engineering female-expressed translational fusion proteins useful in the methods of the disclosure.

As used herein, "heterologous" refers to a nucleic acid that originates from a foreign species, or, if from the same species, is substantially modified from its native form in composition and/or genomic locus by deliberate human intervention. For example, a promoter operably linked to a heterologous structural gene that is from a species different from that from which the structural gene was derived, or, if from the same species, one or both are substantially modified from their original form and/or genomic location.

The embryogenesis inducing embryogenesis factor and/or morphogenic developmental genes useful in the methods of the disclosure can be provided in expression cassettes for expression in the plant of interest. The cassette can include 5' and 3' regulatory sequences operably linked to an embryogenesis inducing embryogenesis factor and/or morphogenic developmental gene sequence disclosed herein. "Operably linked" is intended to mean a functional linkage between two or more elements. For example, an operable linkage between a polynucleotide of interest and a regulatory sequence (i.e., a promoter) is a functional link that allows for expression of the polynucleotide of interest. Operably linked elements may be contiguous or non-contiguous. When used to refer to the joining of two protein coding regions (fusion proteins), by operably linked it is intended that the coding regions are in the same reading frame. The cassette may additionally contain at least one additional gene to be co-transformed into the organism. Alternatively, the embryogenesis inducing embryogenesis factor and/or morphogenic developmental gene(s) can be provided on multiple expression cassettes. Such an expression cassette is provided with a plurality of restriction sites for insertion of the embryogenesis inducing embryogenesis factor and/or morphogenic developmental gene sequence to be under the transcriptional regulation of the regulatory regions (promoter(s)). The expression cassette may additionally contain selectable marker genes.

As used herein, a chimeric signal peptide-embryogenesis factor gene fusion and/or a chimeric signal peptide-morphogenic developmental gene fusion can be further engineered with a translocation or a nuclear localization signal sequence on the C-terminus of the polypeptide to promote improved cellular reprogramming efficiency and embryogenesis induction. The methods of the present disclosure provide a genetic construct encoding a WUSCHEL protein fused with a polypeptide derived from bacterial virulence proteins conferring in planta translocation of secreted proteins. *Agrobacterium tumefaciens* and *Agrobacterium rhizogenes* are examples of plant pathogens that can transfer plasmid-encoded bacterial genes located on the transferred DNA (T-DNA) into plant cells in a manner dependent on the translocation of bacterial virulence (Vir) proteins. Translocations of fusions between CRE recombinase with VIR protein polypeptides, specifically VirE2 or VirF peptide sequences, directly demonstrated a role conferred by the Vir peptides for protein translocation into plant cells (Vergunst et al., (2000) Science 290: 979-82). Further, the C-terminal 27 amino acids of the *A. rhizogenes* GALLS protein was shown to have a role in protein transport and nuclear localization (Hodges et al., (2006) J. Bacteriol. 188:8222-30). The use of peptides encoding translocation or nuclear localization signals are known in the art (see U.S. Pat. No. 6,800,791 incorporated herein by reference in its entirety).

Expression cassettes useful in the methods of the disclosure may contain a polynucleotide encoding a Ms44 signal peptide-WUSCHEL fusion with a translocation or a nuclear localization signal sequence or a similar Ms44 signal peptide-ODP2 fusion with a translocation fusion peptide which can be further engineered with a cell penetrating peptide, herein referred to herein as a "CPP". CPPs useful in the present methods are a class of short peptides with a property to translocate across cell membranes and act as nanocarriers for protein delivery into plant cells. Exemplary CPP families include, but are not limited to, CPPs derived from protein transduction domains, amphipathic peptides, and synthetic cationic polypeptides, such as polylysine, polyhistidine, and polyarginine, or dendrimeric polycationic molecules. Exemplary CPPs useful in the methods of the disclosure include, but are not limited to, the peptide vascular endothelial-cadherin CPP, the transportan CPP, the monomer and dimer of HIV-1 TAT basic domain Cpp, the penetratin CPP, synthetic cationic homoarginine oligopeptide CPPs (see Eudes and Chugh. (2008) Plant Signal Behav. 3:549-550) and the gamma zein CPP (see U.S. Pat. No. 8,581,036, incorporated herein by reference in its entirety). The present disclosure provides methods of using a gamma-zein CPP morphogenic developmental protein translational fusion protein for use in contacting the gamma-zein linked structure with a plant cell and allowing uptake of the gamma-zein linked structure into the plant cell to alter cell fate of the plant cell. Also provided for use in the methods of the disclosure are engineered embryogenesis inducing morphogenic developmental proteins comprising a CPP fused to the ODP2 protein for use in combination with a chimeric signal peptide-WUSCHEL fusion protein. These genetic constructs are engineered to deliver and contact a microspore with an embryogenesis inducing morphogenic developmental protein comprising a CPP fused to the ODP2 protein for use in combination with the chimeric signal peptide-WUSCHEL fusion proteins operably linked to an anther-specific promoter, or more specifically a tapetum-specific promoter.

As used herein, such genetic constructs can also be engineered to deliver and contact an embryo with an embryogenesis inducing morphogenic developmental protein, more specifically a maize haploid embryo. Also provided for use in the methods of the disclosure are expression cassettes comprising a CPP fused to the ODP2 protein for use in combination with the chimeric signal peptide-WUSCHEL fusion protein operably whereby the proteins are engineered using genetic constructs designed with a chimeric endosperm or a transfer cell layer signal peptide-WUSCHEL fusion protein operably linked to a endosperm-specific promoter and polynucleotides encoding an endosperm or a transfer cell layer signal peptide-ODP2-CPP fusion peptide to translocate the expressed proteins from the endosperm to the embryo.

The present disclosure provides methods in which the chromosomes may be doubled at the microspore stage, at the embryo stage, at the mature seed stage, or anytime between pollination of the plant and before the germination of the haploid seed. Alternatively, spontaneous doubling may also occur.

The ex situ methods of the present disclosure promote microspore embryogenesis and cellular reprogramming by contacting an isolated microspore with a embryogenesis inducing morphogenic developmental protein. Isolated microspores may be specifically contacted with an exogenous embryogenesis inducing morphogenic developmental protein to improve maize microspore embryogenesis. For example, as disclosed herein the ex situ embryogenesis inducing morphogenic developmental protein treatment cellular reprogramming method uses a heterologous expression system to produce a purified, recombinant WUSCHEL protein. The methods of the present disclosure include delivery of the protein to the plant cell, for example using transfection reagents to further promote delivery of the exogenous WUSCHEL protein to the isolated microspore cells. In some aspects, the protein delivery method, with or without transfection reagents, can include electroporation methods and/or sonication methods, performed in the presence of agents such as dimethyl sulfoxide (DMSO), adjuvants, surfactants, and the like, that further promote delivery of an exogenous embryogenesis inducing morphogenic developmental protein into the microspore cells.

Also provided are, ex situ methods comprising contacting or treating an isolated microspore with an agent such as a small molecule or compound that enables cell fate reprogramming and stimulates embryogenic cell proliferation. The present disclosure provides methods comprising co-culturing isolated microspores in an induction media supplemented with a small molecule or compound. In some aspects, small-molecule inhibitors of protein kinases are used in the methods of the disclosure to cellularly reprogram a plant cell.

The methods of the disclosure also provide combining the protein delivery cellular reprogramming method, with or without transfection reagents, with and without electroporation methods and/or sonication methods, which may be performed in the presence of agents such as dimethyl sulfoxide (DMSO), adjuvants, surfactants, and the like described above and the cellular reprogramming treatments using a small molecule or compound described above to improve cellular reprogramming of a plant cell.

The methods of the disclosure also provide that the ex situ and/or in planta methods can subsequently include co-culturing the isolated microspores in contact with maize suspension "feeder cells" possessing embryogenic and cellular reprogramming properties. In particular, the method comprises co-culturing isolated microspores in the presence of transgenic maize suspension cell cultures transformed with a genetic construct expressing an embryogenesis inducing morphogenic developmental gene, such as the WUSCHEL protein and/or ODP2.

In an aspect, the feeder cells are engineered to express polynucleotides encoding polypeptides involved in growth stimulation, embryogenesis, cellular reprogramming, and/or cell cycle stimulation to increase the frequency of haploid embryos, to increase the frequency of initiation of microspore-derived embryos, and/or to stimulate and increase chromosomal doubling efficiency. Polynucleotides useful in the methods of the disclosure include, but are not limited to, embryogenesis inducing morphogenic developmental genes and cell cycle genes including Cyclin A, Cyclin B, Cyclin C, Cyclin D, Cyclin E, Cyclin F, Cyclin G, and Cyclin H; Pin1; E2F; Cdc25; RepA genes and similar plant viral polynucleotides encoding replication-associated proteins. See U.S. Patent Publication No. 2002/0188965 incorporated herein by reference in its entirety.

In an aspect, the disclosure provides methods comprising co-culturing isolated microspores in the presence of non-transgenic maize suspension cell cultures (feeder cells), more specifically using feeder cells derived from genotypes with responsive androgenic phenotypes, such as for example ATCC40520 or ATCC40519 (see U.S. Pat. No. 5,306,864 A incorporated herein by reference in its entirety), or non-transgenic, responsive inbred strains such as HF1 (Martin and Widholm, (1996)).

The in planta method of the disclosure promotes embryogenesis from a tissue or organ of a plant by ectopically expressing a morphogenic developmental protein in a tissue or organ or in an adjacent tissue or organ. Genetic elements providing spatiotemporal expression and localization to particular tissues or organs of a plant are useful in the methods of the disclosure.

In an aspect, a promoter employed in the methods of the disclosure is the native Z. mays Ms44 promoter (SEQ ID NO: 318) resulting in exploitation of the spatiotemporal expression and localization characteristic properties of Ms44, an anther-specific gene that is first detected in the tapetum cells during meiosis that persists through uninucleate microspore development.

A signal peptide useful in the methods of the disclosure is the native Z. mays Ms44 signal peptide (SEQ ID NO:320).

In the present disclosure, a heterologous expression cassette encoding the Ms44 promoter (SEQ ID NO: 318) regulating the anther-specific Ms44signal peptide (SEQ ID NO: 320) is fused to a polynucleotide encoding the WUSCHEL peptide (SEQ ID NO:322), thereby ectopically expressing the embryogenesis inducing morphogenic developmental gene during microgametogenesis. The methods of the disclosure allow embryogenesis inducing morphogenic developmental gene protein synthesis and processing in the tapetum cells for secretion into the locule, thus resulting in contact with the microspores and activity of the embryogenesis inducing morphogenic developmental protein to induce cellular reprogramming and activate microspore embryogenesis.

As used herein, a "chimeric gene expression cassette" is an expression cassette comprising a coding sequence operably linked to a transcription initiation region that is heterologous to the coding sequence and can include in the 5'-3' direction of transcription, a transcriptional initiation region (i.e., a promoter) and translational initiation region, a secretion signal peptide, an embryogenesis inducing morphogenic developmental gene sequence, a fluorescent protein sequence, and a transcriptional and translational termination region (i.e., termination region) functional in plants.

In an aspect, genetic constructs useful in the methods of the disclosure include a polynucleotide encoding a Ms44 promoter and Ms44 secretion signal peptide fused to a WUSCHEL protein which is also fused with a C-terminal 36 amino acid VirF translocation peptide sequence (SEQ ID NO: 329), herein called "virF$^{C36}$", or is optionally fused to a C-terminal 127 amino acid VirF translocation peptide sequence (SEQ ID NO: 331), herein called "virF$^{C127}$", or is optionally fused to a 27 amino acid translocation signal peptide from the A. rhizogenes GALLS protein (SEQ ID NO: 333), herein called "GS$^{C27}$" to promote increased morphogenic activity and cellular reprogramming.

In an aspect, genetic constructs useful in the methods of the disclosure with embryogenesis inducing morphogenic developmental gene protein activity (cellular reprogramming and embryogenesis induction activity) can also include fusion of the embryogenesis inducing morphogenic developmental gene with a cell penetrating peptide to increase cellular delivery and activity in a cell non-autonomous manner (increasing the embryogenesis inducing impact on surrounding/adjacent cells).

In an aspect, genetic constructs useful in the methods of the disclosure with embryogenesis inducing morphogenic developmental gene protein activity (cellular reprogramming and embryogenesis induction activity) can also include fusion of the embryogenesis inducing morphogenic developmental gene with a glucocorticoid receptor (GR)-based fusion protein system (SEQ ID NO: 363 encoding SEQ ID NO: 364) to conditionally localize protein activity to the nucleus by external application of animal hormone analogs into the in vitro tissue culture.

Promoters useful in the methods of the disclosure include the ZmBETL9 and 5' untranslated region or ZmBETL9-like promoter and 5' untranslated region (SEQ ID NO: 348 and SEQ ID NO: 351, respectively) is fused to a polynucleotide encoding an embryogenesis inducing morphogenic developmental gene, such as, the WUSCHEL peptide (SEQ ID NO: ) or the OVULE DEVELOPMENT PROTEIN 2 (ODP2) (SEQ ID NO: 335), thereby ectopically regulating embryogenesis inducing morphogenic developmental gene expression during embryogenesis.

Endosperm secretion signal peptides, such as the N-terminal ZmBETL9 secretion signal peptide or ZmBETL9-like secretion signal peptide (SEQ ID NO: 347 and SEQ ID NO: 350, respectively) which are fused to an embryogenesis inducing morphogenic developmental gene protein thereby enabling protein translocation from the endosperm to the embryo cells during embryogenesis are useful in the method of the disclosure. Optionally, a translational fusion protein comprising a secretion signal peptide and an embryogenesis inducing morphogenic developmental gene protein can be fused to a translocation signal peptide. In an aspect, a translational fusion protein can comprise a cell penetrating peptide. The methods disclosed herein enable improved embryogenesis and cellular reprogramming in plant cells which also improve cellular responses in subsequent plant tissue culture methods.

The in planta cellular reprogramming methods of the disclosure improve maternal haploid embryo regeneration productivity and enable gene editing to provide regenerated gene-edited, maize doubled haploids wherein the treated cells, while not transgenic, are in contact with a embryogenesis inducing morphogenic developmental gene protein derived from triploid endosperm cells comprising one paternal allele expressing a trait that is a stable transformant.

In some aspects, a heterologous expression cassette encoding the ZmBETL9 promoter, 5' untranslated region (SEQ ID O: 348), and the N-terminal ZmBETL9 secretion signal peptide (SEQ ID NO: 346) or the ZmBETL9-like promoter, 5' untranslated region (SEQ ID NO: 351), and the N-terminal ZmBETL9-like secretion signal peptide (SEQ ID NO: 349) is fused to a polynucleotide encoding an embryogenesis inducing morphogenic developmental gene protein such as, the WUSCHEL peptide (SEQ ID NO: 322) or the OVULE DEVELOPMENT PROTEIN 2 (ODP2) peptide (SEQ ID NO: 335), is used in the methods of the disclosure thereby ectopically regulating embryogenesis inducing morphogenic developmental gene expression during embryogenesis.

In an aspect, haploid cells can be contacted with an amount of a chromosome doubling agent to promote chromosome doubling followed by regenerating homozygous diploid plants from the treated haploid cells. The haploid microspore cells can be in contact with the doubling agent before, during, or after initiation of microspore embryogenesis or embryo maturation. After chromosome doubling, the doubled haploid embryo will contain 2 copies of paternally derived chromosomes. The efficiency of the process for obtaining doubled haploid plants from haploid embryos may be greater than 10%, 20%, 30%, 50%, 60%, 70%, 80%, or 90%. The duration of contact between the haploid cells and the chromosomal doubling agent may vary. Contact may be from less than 24 hours, for example 4-12 hours, to about a week. The duration of contact is generally from about 8 hours to 2 days.

Methods of chromosome doubling are disclosed in Antoine-Michard, S. et al., Plant cell, tissue organ cult., Cordrecht, the Netherlands, Kluwer Academic Publishers, 1997, 48(3):203-207; Kato, A., Maize Genetics Cooperation Newsletter 1997, 36-37; and Wan, Y. et al., TAG, 1989, 77: 889-892. Wan, Y. et al., TAG, 1991, 81: 205-211. The disclosures of which are incorporated herein by reference. Typical doubling methods involve contacting the cells with colchicine, anti-microtubule agents or anti-microtubule herbicides, pronamide, nitrous oxide, or any mitotic inhibitor to create homozygous doubled haploid cells. The amount of colchicine used in medium is generally 0.01%-0.2% or approximately 0.05% of amiprophos-methyl (APM) (5-225 µM) may be used. The amount of colchicine can range from approximately 400-600 mg/L or approximately 500 mg/L. The amount of pronamide in medium is approximately 0.5-20 µM. Examples of mitotic inhibitors are included in Table 2. Other agents may be used with the mitotic inhibitors to improve doubling efficiency. Such agents include dimethyl sulfoxide (DMSO), adjuvants, surfactants, and the like.

TABLE 2

Chemical chromosome doubling agents

| Common Name/ Trade name | CAS | IUPAC |
|---|---|---|
| Colchicine and Colchicine Derivatives | | |
| colchicine/ acetyltrimethylcolchicinic acid colchicine derivatives | | (S)-N-(5,6,7,9-tetrahydro-1,2,3,10-tetramethoxy-9-oxobenzo (a) heptalen-7-yl) acetamide |
| Carbamates | | |
| Carbetamide | (R)-1-(ethylcarbamoyl)ethyl carbanilate | (2R)-N-ethyl-2-[[(phenylamino)carbonyl]oxy]propanamide |
| chloropropham Propham Benzamides | | |
| Pronamide/ propyzamide | 3,5-dichloro-N-(1,1-dimethylpropynyl)benzamide | 3,5-dichloro-N-(1,1-dimethyl-2-propynyl)benzamide |
| Tebutam | | |
| Benzoic Acids | | |
| Chlorthal dimethyl (DCPA), Dicamba/dianat/ disugran (dicamba-methyl) (BANVEL, CLARITY) | 3,6-dichloro-o-anisic acid | 3,6-dichloro-2-methoxybenzoic acid |
| Dinitroaniline chromosome doubling agents | | |
| benfluralin/benefin/ (BALAN) | N-butyl-N-ethyl-α,α,α-trifluoro-2,6-dinitro-p-toluidine | N-butyl-N-ethyl-2,6-dinitro-4-(trifluoromethyl)benzenamine |
| Butralin | (RS)-N-sec-butyl-4-tert-butyl-2,6-dinitroaniline | 4-(1,1-dimethylethyl)-N-(1-methylpropyl)-2,6-dinitrobenzenamine |
| Chloralin | | |
| dinitramine | N1,N1-diethyl-2,6-dinitro-4-trifluoromethyl-m-phenylenediamine | N3,N3-diethyl-2,4-dinitro-6-(trifluoromethyl)-1,3-benzenediamine |
| ethalfluralin (Sonalan) | N-ethyl-α,α,α-trifluoro-N-(2-methylallyl)-2,6-dinitro-p-toluidine | N-ethyl-N-(2-methyl-2-propenyl)-2,6-dinitro-4-(trifluoromethyl)benzenamine |
| fluchloralin | N-(2-chloroethyl)-2,6-dinitro-N-propyl-4-(trifluoromethyl)aniline or N-(2-chloroethyl)-α,α,α-trifluoro-2,6-dinitro-N-propyl-p-toluidine | N-(2-chloroethyl)-2,6-dinitro-N-propyl-4-(trifluoromethyl)benzenamine |

TABLE 2-continued

Chemical chromosome doubling agents

| Common Name/ Trade name | CAS | IUPAC |
|---|---|---|
| isopropalin | 4-isopropyl-2,6-dinitro-N,N-dipropylaniline | 4-(l-methylethyl)-2,6-dinitro-N,N-dipropylbenzenamine |
| methalpropalin | α,α,α-trifluoro-N-(2-methylallyl)-2,6-dinitro-N-propyl-p-toluidine | N-(2-methyl-2-propenyl)-2,6-dinitro-N-propyl-4-(trifluoromethyl)benzenamine |
| nitralin | 4-methylsulfonyl-2,6-dinitro-N,N-dipropylaniline | 4-(methylsulfonyl)-2,6-dinitro-N,N-dipropylbenzenamine |
| oryzalin (SURFLAN) | 3,5-dinitro-N4,N4-dipropylsulfanilamide | 4-(dipropyl amino)-3,5-dinitrobenzenesulfonamide |
| pendimethalin (PROWL) | N-(1-ethylpropyl)-2,6-dinitro-3,4-xylidine | N-(1-ethylpropyl)-3,4-dimethyl-2,6-dinitrobenzenamine |
| prodiamine | 5-dipropylamino-α,α,α-trifluoro-4,6-dinitro-o-toluidine or 2,6-dinitro-N1,N1-dipropyl-4-trifluoromethyl-m-phenylenediamine | 2,4-dinitro-N3,N3-dipropyl-6-(trifluoromethyl)-1,3-benzenediamine |
| profluralin | N-cyclopropylmethyl-α,α,α-trifluoro-2,6-dinitro-N-propyl-p-toluidine or N-cyclopropylmethyl-2,6-dinitro-N-propyl-4-trifluoromethylaniline | N-(cyclopropylmethyl)-2,6-dinitro-N-propyl-4-(trifluoromethyl)benzenamine |
| trifluralin (TREFLAN, TRIFIC, TRILLIN) | α,α,α-trifluoro-2,6-dinitro-N,N-dipropyl-p-toluidine | 2,6-dinitro-N,N-dipropyl-4-(trifluoromethyl)benzenamine |
| Phosphoroamidates | | |
| APM (Amiprofos methyl); amiprophos-methyl | | |
| Butamifos | O-ethyl O-6-nitro-m-tolyl (RS)-sec-butylphosphoramidothioate | O-ethyl O-(5-methyl-2-nitrophenyl) (1-methylpropyl)phosphoramidothioate |
| Pyridines | | |
| Dithiopyr | | |
| Thiazopyr | methyl 2-difluoromethyl-5-(4,5-dihydro-1,3-thiazol-2-yl)-4-isobutyl-6-trifluoromethylnicotinate | methyl 2-(difluoromethyl)-5-(4,5-dihydro-2-thiazolyl)-4-(2-methylpropyl)-6-(trifluoromethyl)-3-pyridinecarboxylate |

As an alternative to using chemical chromosome doubling agents, modulating expression of genes known to impact the plant cell cycle (genetic chromosome doubling protein), either through stimulation of the cell cycle (and cell division) or through stimulation of endoreduplication, can be used to double the chromosome complement in an embryo. Increasing ploidy level in plant cells can be achieved by modulating expression of genes that stimulate key control points in the cell cycle cell. In the present disclosure it has been demonstrated that over-expression of BBM[404] using an egg-cell promoter enhanced formation of haploid embryos, while simultaneous expression of BBM[404] and ZM-DZ470 (a maize cyclin-D family member) not only resulted in haploid embryo formation but also stimulated doubling of the chromosome number. Thus, the addition of cyclin-D over-expression in the forming haploid embryo appears to provide an appropriate level of cell cycle stimulation to result in doubling of the 1n haploid chromosome number to 2n (diploid). It is expected that other plant genes known to simulate the cell cycle (or cell division) in plants can be used to produce a similar doubling of the chromosome number in the forming embryos. Examples of plant genes whose over-expression stimulates the cell cycle include cyclin-A in tobacco (Yu et al., 2003), cyclin-D in tobacco (Cockcroft et al., 2000, Nature 405:575-79; Schnittger et al., 2002, PNAS 99:6410-6415; Dewitte et al., 2003, Plant Cell 15:79-92)., E2FA in Arabidopsis (De Veylder et al., 2002, EMBO J 21:1360-1368), E2FB in Arabidopsis (Magyar et al., 2005, Plant Cell 17:2527-2541). Similarly, over-expression of viral genes known to modulate plant cell cycle machinery can be used, such as when over-expression of the Wheat Dwarf Virus RepA gene stimulates cell cycle progression (G1/S transition) and cell division in maize (Gordon-Kamm et al., 2002, PNAS 99:11975-11980). Conversely, plant genes whose encoded products are known to inhibit the cell cycle have been shown to result in increased cell division when the gene, such as Cyclin-Dependent Kinase Inhibitor (ICK1/KRP), is down-regulated in Arabidopsis (Cheng et al 2013, Plant J 75:642-655). Thus, down-regulation of the KRP gene using an egg-cell-specific promoter to drive expression would be expected to have a similar effect as over-expression of DZ470, resulting in chromosome doubling. Methods of down-regulation of a gene such as KRP are known in the art and include expression of an artificial micro-RNA targeted to the KRP mRNA, or expression of a dCas9-repressor fusion that is targeted to the KRP promoter by a gRNA to that sequence. Finally, there are plant genes that are known to specifically impact the process of endoreduplication. When using such genes, such as for example the ccs52gene or the Del1 gene, in the methods of the present disclosure, it is expected that over-expression of ccs52 would result in an increased ploidy level as observed in *Medicago sativa* (Cebolla et al., 1999, EMBO J 18:4476-4484), and that down-regulation of Del1 would result in an increased ploidy level as observed in *Arabidopsis* (Vlieghe et al., 2005, Current Biol 15:59-63). It is expected that other genes that are known to stimulate the cell cycle, the G1/S transition, or endoreduplication can be used in the methods disclosed herein to increase ploidy level.

An exemplary pathway for maintaining stem cell homeostasis in plant cells wherein shoot meristems are maintained by pluripotent stem cells is the CLAVATA-WUSCHEL feedback signaling pathway. This pathway coordinates maintaining stem cell proliferation with differentiation. Although first identified in *Arabidopsis*, this pathway appears to be conserved in diverse higher plant species, such as maize, rice and tomato (Somssich et al., 2016. Development 143:3238-3248). The pathway comprises the stem cell-promoting transcription factor WUS and the differentiation-promoting peptide CLAVATA3 (CLV3) (Brand, U., et al., 2000. Science 289:617-619). While conserved in diverse higher plant species, it has also been shown that multiple receptors also function in regulating stem cell and development in other plants, such as the rice gene FON1 (Suzaki, T, et al. 2006. Plant Cell Physiol. 47:1591-1602), the *Zea mays* CLAVATA 2 orthologs THICK TASSEL DWARF1 (TD1) and FASCIATED EAR2 (FEA2) (Bommert, P., et al., 2005. Development 132:1235-1245), and the *Zea mays* CLV-type LRR receptor-like gene, FASCIATED EAR3 (FEA3) (Je, et al., 2016. Nat. Genet. 48:785-791). Thus, such species-specific proteins that can repress induced cellular reprogramming provided by a treating a cell with a morphological developmental protein are relevant to the present disclosure.

In another example, developmental regulation of the *Arabidopsis thaliana* floral meristem it has been shown repression of WUS is controlled by expression the AGAMOUS (AG) protein. Here, AG directly induces the transcription of KNUCKLES (KNU), encoding a C2H2-type zinc finger protein with a conserved transcriptional repression motif, that represses WUS transcription to abolish stem cell activity, thereby controlling floral meristem determinacy (Sun. B, et al., 2009. Gene Dev 23:1791-804). For this pathway of stem cell regulation in flower development, a key aspect to coordinating stem cell maintenance and differentiation is not only the temporal expression patterns, wherein WUS activity activates AG activity, and AG activates KNU transcription, but also in how the KNU locus in regulated. Notably, KNU transcription by AG require removal of a repressive histone modification at the KNU locus, for example removal of tri-methylation at the 27th lysine residue of the histone H3 protein (H3K27me3). This repressive mark is removed in an AG-dependent manner. For the methods of the present disclosure wherein WUS activity has a mechanistic link between transcriptional feedback and epigenetic regulation in plant stem cell proliferation, it is expected that targeted repression of a positively activated WUS repressor, such as KNU or other such repressor proteins, is likewise of interest.

It can be expected that ectopic WUS protein activity in a plant cell will positively regulate signaling pathway responses to repress WUS activity. Here, genetic loci encoding said proteins acting to repress WUS activity are considered useful as genomic target sites for methods of the current disclosure.

Several other genetic loci acting as negative switches of embryogenesis have also been identified. The PICKLE (PKL) gene encodes a CHD3 chromatin-remodeling factor and embryonic traits ectopically developed within roots when a loss of PKL function occurred (Ogas J., et al., 1997. Science. 277:91-94; Ogas J, et al., 1999. Proc. Natl Acad. Sci. USA. 96:13839-13844). In pkl seedlings, LEC-class genes were derepressed, thereby showing such developmental genes are silenced via repressive chromatin states (Dean Rider, S. et al., 2003. Plant J. 35: 33-43). This finding is further supported by results showing strong expression of PKL during germination and establishment of repressive H3K27me3 modifications for PKL-dependent genes (Henderson J T. et al., 2004. Plant Physiol 134:995-1005; Zhang H. et al., 2008. J Biol Chem 283:22637-22648).

Likewise, defects in three VP1/ABI3-LIKE (VAL) genes induced the expression of embryogenic traits in seedling, again characterized by ectopic LEC1 activation (Suzuki M. et al., 2007. Plant Physiol 143:902-911). VAL genes encode transcriptional regulators containing PHD-like and CW domains characteristic of chromatin remodeling proteins, EAR transcriptional repressor domains, and B3 DNA-binding domains (Suzuki M. et al., 2007. Plant Physiol 143:902-911). Additionally, several polycomb-group proteins and two histone deacetylases, HDA6 and HDA19, have been reported as essential to repress embryonic traits after germination (Makarevich, G. et al. 2006. EMBO Rep 7:947-952; Tanaka, M. et al. 2008. Plant Physiol 146:149-161). In another example, PHERES1 and FUSCA3 were shown as potential PcG target genes, and thus, it was proposed that different PcG complexes repress such target genes during the different stages of plant development to promote differentiation (Makarevich, G. et al., 2006. EMBO Rep. 7:947-52).

Repressor motifs are known in the art, for example see Kagale and Rozwadowski (Epigenetics. 2011. 6: 141-146). Ethylene-responsive element binding factor-associated Amphiphilic Repression (EAR) motif-mediated transcriptional repression is known in plants, including EAR motifs defined by the consensus sequence patterns of either LxLxL and DLNxxP (see Hiratsu et al., 2003. Plant J. 35:177-192). Of interest to the present disclosure are peptides including the amphiphilic repression motif disclosed in WO 2013/109754 A1 and all references cited therein and the Dr1/DRAP1 global repressor complex (see U.S. Pat. No. 7,288,695 B2 and all references cited therein), including the Dr1 motif that is similar to the motif found in *Arabidopsis thaliana* MYBL2 (see Matsui K, Umemura Y, Ohme-Takagi M. 2008. Plant J. 55:954-967).

In planta methods of the disclosure provide stable transgenic "microspore activator" parental inbred lines useful in genetic crosses with a second, wild type parent inbred line to create a first generation $F_1$ hybrid.

The methods of the disclosure, in an aspect, use this hemizygous transgenic $F_1$ hybrid for generating an immature tassel that can produce florets with anthers containing developing microspores. The microspores are the products of meiosis, and thus, each male gamete has a unique combination of genes inherited from the parents along recombined chromosomes due to chromosomal crossover events during meiosis. A single copy transgene that is at a single locus in a hemizygous state can segregate in a 1:1 ratio during meiosis resulting in half of the gametes being wild type and the other half of the gametes having inherited the transgenic locus. After meiosis, the wild type and transgenic gametes continue to develop in planta with all developing microspores exposed to the embryogenesis inducing morphogenic developmental gene protein which is secreted from sporophytic tapetum cells originating from protein translation of the single copy of the transgene in the hemizygous $F_1$ genome. Upon isolation of the microspores from the tassel tissues, the methods of the disclosure induce cellular programming activity during microgametogenesis to improve microspore embryogenesis responsiveness and cellular reprograming in vitro. Selection of non-transgenic microspore-derived embryoids is performed using standard methods.

In an aspect, two different inbred strains are cross-fertilized to create first generation $F_1$ zygotic embryos developing within the fertilized ear of the maternal parent. Each $F_1$ zygotic embryo has two sets (genomes) of chromosomes, one from each parent. The immature $F_1$ zygotic embryos can be subsequently isolated from the maternal ear after fertilization, for example 8 to 16 days after fertilization, for transformation purposes to stably integrate into the $F_1$ plant genome a polynucleotide encoding an embryogenesis inducing cellular reprogramming factor. In this manner, selection of $F_1$ plants with a single copy of the embryogenesis inducing cellular reprogramming genetic construct in a hemizygous state can be performed for sampling tassel tissues producing microspores within anthers. In respect to the inserted embryogenesis inducing cellular reprogramming transgene, the microspores will segregate in a 1:1 ratio during gametogenesis resulting in half of the gametes being wild type and the other half of the gametes having inherited the transgenic embryogenesis inducing cellular reprogramming locus. The methods of the disclosure thereby allow for selecting $F_2$ generation wild-type microspores with improved embryogenesis responsiveness from a hemizygous $F_1$ hybrid for creating doubled haploid populations.

In an aspect, the methods of the disclosure also provide in planta protein delivery. The methods comprise transforming a maize haploid inducer line to stably integrate and express a heterologous expression cassette, or cassettes, encoding two major functional activities: one activity comprising proteins for inducing somatic embryogenesis and cellular reprogramming and a second activity comprising proteins useful for gene editing purposes. Both components are operably linked to a promoter, or promoters, expressed within the endosperm, specifically the embryo surrounding region (ESR) and/or the Basal Endosperm Transfer Layer (BETL). The methods of the disclosure use the transformed haploid inducer line for fertilizing the maternal ear of a target plant to generate haploid embryos with improved doubled haploid plantlet regeneration and/or improved regeneration of gene-edited, doubled haploid progeny. In these methods, expression of a heterologous expression cassette comprising an embryogenesis inducing morphogenic developmental gene protein from the paternal allele within triploid endosperm cells results in the proteins being translocated through transfer cells into the haploid embryo using secretion signal peptides characteristic of endosperm transfer cells. The present methods provide maternal haploid embryo having increased levels of embryogenesis and plantlet regeneration capabilities once rescued haploid embryos are cultured in vitro.

sgRNA hybridizes to intragenic DNA and can have a regulatory role and affect gene regulation at the target site. This finding is consistent with the regulatory role shown for bidirectionally expressed long non-coding RNA (lncRNA) transcripts that can either silence or activate a gene. For example, transcription of RNA molecules from Polycomb/Trithorax response elements (PRE/TRE) downstream of the vestigial (vg) gene in Drosophila were shown to affect gene regulation, wherein forward-strand transcripts were correlated with vg repression and reverse-strand transcripts were associated with activation of vg expression (Herzog, et al., 2014. Nat. Genet. 46:973-981). More specifically, reverse transcribed long, non-coding RNA (lncRNA) bound to a subunit of the Polycomb group Complex (PcG) inhibited PcG histone methyltransferase activity and sequestered the repressive PcG complex from the vg locus, thereby activating vg gene expression. It is also relevant that promiscuous in vitro binding of a PcG protein and RNA can occur and that non-specific RNA binding to a mammalian PcG complex inhibited PcG activity (Davidovich, et al., 2013. Nat. Struct. Mol. Biol. 20: 1250-1257; Cifuentes-Rojas, et al., 2014. Mol. Cell 55:171-185). Such binding can explain how sgRNA used in the cellular reprogramming methods of the present disclosure acts as a functional switch controlling gene regulation at a genomic target site.

In plant cells, conservation of PcG activity is known and is relevant to regulating developmental regulatory genes including the morphogenic genes used in the cellular reprogramming methods of the present disclosure. In Arabidopsis, the WUS locus is silenced after recruitment of PcG proteins leads to established H3K27me3 post-translational modifications, thereby resulting in WUS gene repression (Liu, et al. 2011. Plant Cell 23:3654-3670). In maize, PcG proteins that deposit H3K27me3 are conserved and elevated levels of H3K27me3 deposited to the BBM locus in tassel compared to leaf tissue was reported (Makarevitch et al. 2013. The Plant Cell, Vol. 25: 780-793), suggesting that BBM repression mediated by PcG activity in isolated and cultured maize microspores is likely.

Taken together, these results demonstrate that providing an RNA molecule with sequence homology to a locus encoding a morphogenic developmental gene can improve cellular reprogramming, for example by activating expression of the targeted gene, with or without activity of a heterologous dCas9 fusion protein. Promiscuous binding of a PcG and RNA as previously shown can explain how the sgRNA used in the methods of the present disclosure improved cellular reprogramming in treated cells, for example, by inhibiting PcG activity, thereby increasing WUS and/or BBM expression.

Methods are known in the art for creating haploid inducer lines, for example by ectopically expressing AP2 domain containing transcription factors. For example, preferably the method of Gordon-Kamm et al. was used (see U.S. Pat. No. 7,579,529; the contents of which are hereby incorporated by reference).

Additionally, the Pennisetum squamulatum AP2 transcription factor, Apospory-Specific-Genomic-Region Baby-BoomLike (herein referred to as PsASGR-BBML) transgene was shown to induce parthenogenesis and embryo formation without fertilization. In maize, individuals with a PsASGR-BBML transgene fertilized with pollen having the R1-navajo anthocyanin color markers exhibited haploid embryo production (Steffen J G, et al. 2007. Plant J 51:281-292, US2016/0304901 A1, herein incorporated by reference in their entirety). More recently, the method of Khanday and Sundaresan demonstrated similar findings, for example in rice (see WO2018/098420 A1; the contents of which are hereby incorporated by reference).

A description of SEQ ID NOS: 316-364 is presented in Table 3.

TABLE 3

| SEQ ID NO: | Polynucleotide (DNA) or Polypeptide (PRT) | Name | Description |
|---|---|---|---|
| 316 | DNA | WUS-histag | WUS-hexahistidine-tagged coding sequence |
| 317 | PRT | WUS-histag | WUS-hexahistidine-tagged amino acid sequence |
| 318 | DNA | ZM-Ms44 PRO | Zea mays Ms44 promoter sequence |
| 319 | DNA | ZM-Ms44SP | Zea mays Ms44 signal peptide coding sequence |
| 320 | PRT | ZM-Ms44SP | Zea mays Ms44 signal peptide amino acid sequence |
| 321 | DNA | ZM-WUS2 | Zea mays WUS2 coding sequence |
| 322 | PRT | ZM-WUS2 | Zea mays WUS2 amino acid sequence |
| 323 | DNA | L3 | Linker3 coding sequence |
| 324 | PRT | L3 | Linker3 amino acid sequence |
| 325 | DNA | AC-GFP1 | Aequorea coerulescens GFP1 coding sequence |
| 326 | PRT | AC-GFP1 | Aequorea coerulescens GFP1 amino acid sequence |
| 327 | DNA | ZM-Ms44 TERM | Zea mays Ms44 terminator coding sequence |
| 328 | DNA | WUS-virF$^{C36}$ | WUS-virF$^{C36}$ translational fusion coding sequence |
| 329 | PRT | WUS-virF$^{C36}$ | WUS-virF$^{C36}$ translational fusion amino acid sequence |
| 330 | DNA | WUS-virF$^{C127}$ | WUS-virF$^{C127}$ translational fusion coding sequence |
| 331 | PRT | WUS-virF$^{C127}$ | WUS-virF$^{C127}$ translational fusion amino acid sequence |
| 332 | DNA | WUS-GALLS (GS$^{C27}$) | WUS-GALLS (GS$^{C27}$) translational fusion coding sequence |
| 333 | PRT | WUS-GALLS (GS$^{C27}$) | WUS-GALLS (GS$^{C27}$) translational fusion amino acid sequence |
| 334 | DNA | ZM-ODP2 | Zea mays ODP2 coding sequence |
| 335 | PRT | ZM-ODP2 | Zea mays ODP2 amino acid sequence |
| 336 | DNA | ZM-KNT1 CPP | Zea mays knotted 1 CPP coding sequence |
| 337 | PRT | ZM-KNT1 CPP | Zea mays knotted 1 CPP amino acid sequence |
| 338 | DNA | SP-TP10 CPP | Saccharomyces pombe TP10 CPP coding sequence |
| 339 | PRT | SP-TP10 CPP | Saccharomyces pombe TP10 CPP amino acid sequence |
| 340 | DNA | CA-Zebra CPP | Candida albicans Zebra CPP coding sequence |
| 341 | PRT | CA-Zebra CPP | Candida albicans Zebra CPP amino acid sequence |
| 342 | DNA | PEP1 CPP | PEP1 CPP coding sequence |
| 343 | PRT | PEP1 CPP | PEP1 CPP amino acid sequence |
| 344 | DNA | HIV-1 TAT CPP | HIV-1 TAT CPP coding sequence |
| 345 | PRT | HIV-1 TAT CPP | HIV-1 TAT CPP amino acid sequence |
| 346 | DNA | ZM-BETL9SP | Zea mays Basal Endosperm Transfer Layer 9 secretion signal peptide coding sequence |
| 347 | PRT | ZM-BETL9SP | Zea mays Basal Endosperm Transfer Layer 9 secretion signal peptide amino acid sequence |
| 348 | DNA | ZM-BETL9 PRO | Zea mays Basal Endosperm Transfer Layer 9 promoter coding sequence |
| 349 | DNA | ZM-BETL9-likeSP | Zea mays Basal Endosperm Transfer Layer9-like secretion signal peptide coding sequence |
| 350 | PRT | ZM-BETL9-likeSP | Zea mays Basal Endosperm Transfer Layer9-like secretion signal peptide amino acid sequence |
| 351 | DNA | ZM-BETL9-like PRO | Zea mays Basal Endosperm Transfer Layer9-like promoter coding sequence |
| 352 | DNA | ODP2C445 | ODP2C445-GALLS$^{C27}$-FLAG coding sequence |
| 353 | PRT | ODP2C445 | ODP2C445-GALLS$^{C27}$-FLAG amino acid sequence |
| 354 | DNA | AM-CFP-ZM-FEM2 | Anemonia majano Cyan Fluorescent Protein (CFP) operably linked to the Zea mays FEM2 promoter coding sequence |
| 355 | DNA | TA-T2A | Thosea asigna virus T2A coding sequence |
| 356 | PRT | TA-T2A | Thosea asigna virus T2A amino acid sequence |

TABLE 3-continued

| SEQ ID NO: | Polynucleotide (DNA) or Polypeptide (PRT) | Name | Description |
|---|---|---|---|
| 357 | DNA | SP-CAS9 | *Streptococcus pyogenes* (CRISPR) CAS9 nuclease coding sequence |
| 358 | PRT | SP-CAS9 | *Streptococcus pyogenes* (CRISPR) CAS9 nuclease amino acid sequence |
| 359 | DNA | AC-Cpf1 MO | Maize optimized *Acidaminococcus* sp. strain BV3L6 Cpf1 nuclease coding sequence |
| 360 | PRT | AC-Cpf1 | *Acidaminococcus* sp. strain BV3L6 Cpf1 nuclease amino acid sequence |
| 361 | DNA | WUS-histag-GZCPP | WUS-hexahistidine-tagged Gamma-zein CPP translational fusion protein coding sequence |
| 362 | PRT | GZCPP-WUS-histag | WUS-hexahistidine-tagged Gamma-zein CPP translational fusion protein amino acid sequence |
| 363 | DNA | WUS-GR | WUS glucocorticoid receptor (GR) fusion protein coding sequence |
| 364 | PRT | WUS-GR | WUS glucocorticoid receptor (GR) fusion protein amino acid sequence |

Methods are known in the art for the targeted insertion of a polynucleotide at a specific location in the plant genome. The insertion of the polynucleotide at a desired genomic location is achieved using a site-specific recombination system. See, for example, WO99/25821, WO99/25854, WO99/25840, WO99/25855 and WO99/25853, all of which are herein incorporated by reference in their entirety. Briefly, a polynucleotide of interest, flanked by two non-identical recombination sites, can be contained in a T-DNA transfer cassette. The T-DNA transfer cassette is introduced into a plant having stably incorporated into its genome a target site which is flanked by two non-identical recombination sites that correspond to the sites of the transfer cassette. An appropriate recombinase is provided, and the transfer cassette is integrated at the target site. The polynucleotide of interest is thereby integrated at a specific chromosomal position in the plant genome.

The disclosed methods can be used to introduce into explants polynucleotides that are useful to target a specific site for modification in the genome of a plant derived from the explant. Site specific modifications that can be introduced with the disclosed methods include those produced using any method for introducing site specific modification, including, but not limited to, through the use of gene repair oligonucleotides (e.g. US Publication 2013/0019349), or through the use of double-stranded break technologies such as TALENs, meganucleases, zinc finger nucleases, CRISPR-Cas, and the like. For example, the disclosed methods can be used to introduce a CRISPR-Cas system into a plant cell or plant, for the purpose of genome modification of a target sequence in the genome of a plant or plant cell, for selecting plants, for deleting a base or a sequence, for gene editing, and for inserting a polynucleotide of interest into the genome of a plant or plant cell. Thus, the disclosed methods can be used together with a CRISPR-Cas system to provide for an effective system for modifying or altering target sites and nucleotides of interest within the genome of a plant, plant cell or seed. The Cas endonuclease gene is a plant optimized Cas9 endonuclease, wherein the plant optimized Cas9 endonuclease is capable of binding to and creating a double strand break in a genomic target sequence of the plant genome.

The Cas endonuclease is guided by the guide nucleotide to recognize and optionally introduce a double strand break at a specific target site into the genome of a cell. The CRISPR-Cas system provides for an effective system for modifying target sites within the genome of a plant, plant cell or seed. Further provided are methods employing a guide polynucleotide/Cas endonuclease system to provide an effective system for modifying target sites within the genome of a cell and for editing a nucleotide sequence in the genome of a cell. Once a genomic target site is identified, a variety of methods can be employed to further modify the target sites such that they contain a variety of polynucleotides of interest. The disclosed methods can be used to introduce a CRISPR-Cas system for editing a nucleotide sequence in the genome of a cell. The nucleotide sequence to be edited (the nucleotide sequence of interest) can be located within or outside a target site that is recognized by a Cas endonuclease.

CRISPR loci (Clustered Regularly Interspaced Short Palindromic Repeats) (also known as SPIDRs-SPacer Interspersed Direct Repeats) constitute a family of recently described DNA loci. CRISPR loci consist of short and highly conserved DNA repeats (typically 24 to 40 bp, repeated from 1 to 140 times—also referred to as CRISPR-repeats) which are partially palindromic. The repeated sequences (usually specific to a species) are interspaced by variable sequences of constant length (typically 20 to 58 by depending on the CRISPR locus (WO2007/025097 published Mar. 1, 2007).

Cas gene includes a gene that is generally coupled, associated or close to or in the vicinity of flanking CRISPR loci. The terms "Cas gene" and "CRISPR-associated (Cas) gene" are used interchangeably herein.

In another aspect, the Cas endonuclease gene is operably linked to a SV40 nuclear targeting signal upstream of the Cas codon region and a bipartite VirD2 nuclear localization signal (Tinland et al. (1992) Proc. Natl. Acad. Sci. USA 89:7442-6) downstream of the Cas codon region.

As related to the Cas endonuclease, the terms "functional fragment," "fragment that is functionally equivalent," and "functionally equivalent fragment" are used interchangeably herein. These terms refer to a portion or subsequence of the Cas endonuclease sequence in which the ability to create a double-strand break is retained.

As related to the Cas endonuclease, the terms "functional variant," "variant that is functionally equivalent" and "functionally equivalent variant" are used interchangeably herein. These terms refer to a variant of the Cas endonuclease in which the ability to create a double-strand break is retained. Fragments and variants can be obtained via methods such as site-directed mutagenesis and synthetic construction.

In an aspect, the Cas endonuclease gene is a plant codon optimized *Streptococcus pyogenes* Cas9 gene that can recognize any genomic sequence of the form N(12-30)NGG which can in principle be targeted.

Endonucleases are enzymes that cleave the phosphodiester bond within a polynucleotide chain and include restriction endonucleases that cleave DNA at specific sites without damaging the bases. Restriction endonucleases include Type I, Type II, Type III, and Type IV endonucleases, which further include subtypes. In the Type I and Type III systems, both the methylase and restriction activities are contained in a single complex. Endonucleases also include meganucleases, also known as homing endonucleases (HEases), which like restriction endonucleases, bind and cut at a specific recognition site, however the recognition sites for meganucleases are typically longer, about 18 bp or more (Patent application PCT/US 12/30061 filed on Mar. 22, 2012). Meganucleases have been classified into four families based on conserved sequence motifs. These motifs participate in the coordination of metal ions and hydrolysis of phosphodiester bonds. Meganucleases are notable for their long recognition sites, and for tolerating some sequence polymorphisms in their DNA substrates. The naming convention for meganuclease is similar to the convention for other restriction endonuclease. Meganucleases are also characterized by prefix F-, I-, or PI- for enzymes encoded by free-standing ORFs, introns, and inteins, respectively. One step in the recombination process involves polynucleotide cleavage at or near the recognition site. This cleaving activity can be used to produce a double-strand break. For reviews of site-specific recombinases and their recognition sites, see, Sauer (1994) Curr Op Biotechnol 5:521-7; and Sadowski (1993) FASEB 7:760-7. In some examples the recombinase is from the Integrase or Resolvase families. TAL effector nucleases are a new class of sequence-specific nucleases that can be used to make double-strand breaks at specific target sequences in the genome of a plant or other organism. (Miller, et al. (2011) Nature Biotechnology 29:143-148). Zinc finger nucleases (ZFNs) are engineered double-strand break inducing agents comprised of a zinc finger DNA binding domain and a double-strand-break-inducing agent domain. Recognition site specificity is conferred by the zinc finger domain, which typically comprising two, three, or four zinc fingers, for example having a C2H2 structure, however other zinc finger structures are known and have been engineered. Zinc finger domains are amenable for designing polypeptides which specifically bind a selected polynucleotide recognition sequence. ZFNs include an engineered DNA-binding zinc finger domain linked to a non-specific endonuclease domain, for example nuclease domain from a Type Ms endonuclease such as Fok1. Additional functionalities can be fused to the zinc-finger binding domain, including transcriptional activator domains, transcription repressor domains, and methylases. In some examples, dimerization of nuclease domain is required for cleavage activity. Each zinc finger recognizes three consecutive base pairs in the target DNA. For example, a 3-finger domain recognized a sequence of 9 contiguous nucleotides, with a dimerization requirement of the nuclease, two sets of zinc finger triplets are used to bind an 18-nucleotide recognition sequence.

A "Dead-CAS9" (dCAS9) as used herein, is used to supply a transcriptional repressor domain. The dCAS9 has been mutated so that can no longer cut DNA. The dCAS0 can still bind when guided to a sequence by the gRNA and can also be fused to repressor elements. The dCAS9 fused to the repressor element, as described herein, is abbreviated to dCAS9-REP, where the repressor element (REP) can be any of the known repressor motifs that have been characterized in plants. An expressed guide RNA (gRNA) binds to the dCAS9-REP protein and targets the binding of the dCAS9-REP fusion protein to a specific predetermined nucleotide sequence within a promoter (a promoter within the T-DNA). For example, if this is expressed beyond-the border using a ZM-UBI PRO::dCAS9~REP::PINII TERM cassette along with a U6-POL PRO::gRNA::U6 TERM cassette and the gRNA is designed to guide the dCAS9-REP protein to bind the SB-UBI promoter in the expression cassette SB-UBI PRO::moPAT::PINII TERM within the T-DNA, any event that has integrated the beyond-the-border sequence would be bialaphos sensitive. Transgenic events that integrate only the T-DNA would express moPAT and be bialaphos resistant. The advantage of using a dCAS9 protein fused to a repressor (as opposed to a TETR or ESR) is the ability to target these repressors to any promoter within the T-DNA. TETR and ESR are restricted to cognate operator binding sequences. Alternatively, a synthetic Zinc-Finger Nuclease fused to a repressor domain can be used in place of the gRNA and dCAS9~REP (Urritia et al., 2003, Genome Biol. 4:231) as described above.

The type II CRISPR/Cas system from bacteria employs a crRNA and tracrRNA to guide the Cas endonuclease to its DNA target. The crRNA (CRISPR RNA) contains the region complementary to one strand of the double strand DNA target and base pairs with the tracrRNA (trans-activating CRISPR RNA) forming a RNA duplex that directs the Cas endonuclease to cleave the DNA target. As used herein, the term "guide nucleotide" relates to a synthetic fusion of two RNA molecules, a crRNA (CRISPR RNA) comprising a variable targeting domain, and a tracrRNA. In an aspect, the guide nucleotide comprises a variable targeting domain of 12 to 30 nucleotide sequences and a RNA fragment that can interact with a Cas endonuclease.

As used herein, the term "guide polynucleotide" relates to a polynucleotide sequence that can form a complex with a Cas endonuclease and enables the Cas endonuclease to recognize and optionally cleave a DNA target site. The guide polynucleotide can be a single molecule or a double molecule. The guide polynucleotide sequence can be a RNA sequence, a DNA sequence, or a combination thereof (a RNA-DNA combination sequence). Optionally, the guide polynucleotide can comprise at least one nucleotide, phosphodiester bond or linkage modification such as, but not limited, to Locked Nucleic Acid (LNA), 5-methyl dC, 2,6-Diaminopurine, 2'-Fluoro A, 2'-Fluoro U, 2'-O-Methyl RNA, phosphorothioate bond, linkage to a cholesterol molecule, linkage to a polyethylene glycol molecule, linkage to a spacer 18 (hexaethylene glycol chain) molecule, or 5' to 3' covalent linkage resulting in circularization. A guide polynucleotide that solely comprises ribonucleic acids is also referred to as a "guide nucleotide".

Nucleotide sequence modification of the guide polynucleotide, VT domain and/or CER domain can be selected from, but not limited to, the group consisting of a 5' cap, a 3' polyadenylated tail, a riboswitch sequence, a stability control sequence, a sequence that forms a dsRNA duplex, a modification or sequence that targets the guide poly nucleotide to a subcellular location, a modification or sequence that provides for tracking, a modification or sequence that provides a binding site for proteins, a Locked Nucleic Acid (LNA), a 5-methyl dC nucleotide, a 2,6-Diaminopurine nucleotide, a 2'-Fluoro A nucleotide, a 2'-Fluoro U nucleotide; a 2'-O-Methyl RNA nucleotide, a phosphorothioate bond, linkage to a cholesterol molecule, linkage to a polyethylene glycol molecule, linkage to a spacer 18 molecule, a 5' to 3' covalent linkage, or any combination thereof. These modifications can result in at least one additional beneficial feature, wherein the additional beneficial feature is selected from the group of a modified or regulated stability, a subcellular targeting, tracking, a fluorescent label, a binding site for a protein or protein complex, modified binding affinity to complementary target sequence, modified resistance to cellular degradation, and increased cellular permeability.

In an aspect, the guide nucleotide and Cas endonuclease are capable of forming a complex that enables the Cas endonuclease to introduce a double strand break at a DNA target site.

In an aspect of the present disclosure the variable target domain is 12, 13, 14, 15, 16, 17, 18, 19, 20, 21, 22, 23, 24, 25, 26, 27, 28, 29 or 30 nucleotides in length.

In an aspect of the present disclosure, the guide nucleotide comprises a cRNA (or cRNA fragment) and a tracrRNA (or tracrRNA fragment) of the type II CRISPR/Cas system that can form a complex with a type II Cas endonuclease, wherein the guide nucleotide Cas endonuclease complex can direct the Cas endonuclease to a plant genomic target site, enabling the Cas endonuclease to introduce a double strand break into the genomic target site. The guide nucleotide can be introduced into a plant or plant cell directly using any method known in the art such as, but not limited to, particle bombardment or topical applications.

In an aspect, the guide nucleotide can be introduced indirectly by introducing a recombinant DNA molecule comprising the corresponding guide DNA sequence operably linked to a plant specific promoter that is capable of transcribing the guide nucleotide in the plant cell. The term "corresponding guide DNA" includes a DNA molecule that is identical to the RNA molecule but has a "T" substituted for each "U" of the RNA molecule.

In an aspect, the guide nucleotide is introduced via particle bombardment or using the disclosed methods for *Agrobacterium* transformation of a recombinant DNA construct comprising the corresponding guide DNA operably linked to a plant U6 polymerase III promoter.

In an aspect, the RNA that guides the RNA Cas9 endonuclease complex, is a duplexed RNA comprising a duplex crRNA-tracrRNA. One advantage of using a guide nucleotide versus a duplexed crRNA-tracrRNA is that only one expression cassette needs to be made to express the fused guide nucleotide.

The terms "target site," "target sequence," "target DNA," "target locus," "genomic target site," "genomic target sequence," and "genomic target locus" are used interchangeably herein and refer to a polynucleotide sequence in the genome (including choloroplastic and mitochondrial DNA) of a plant cell at which a double-strand break is induced in the plant cell genome by a Cas endonuclease. The target site can be an endogenous site in the plant genome, or alternatively, the target site can be heterologous to the plant and thereby not be naturally occurring in the genome, or the target site can be found in a heterologous genomic location compared to where it occurs in nature.

As used herein, terms "endogenous target sequence" and "native target sequence" are used interchangeably herein to refer to a target sequence that is endogenous or native to the genome of a plant and is at the endogenous or native position of that target sequence in the genome of the plant.

An "artificial target site" or "artificial target sequence" are used interchangeably herein and refer to a target sequence that has been introduced into the genome of a plant. Such an artificial target sequence can be identical in sequence to an endogenous or native target sequence in the genome of a plant but be located in a different position (i.e., a non-endogenous or non-native position) in the genome of a plant.

An "altered target site," "altered target sequence" "modified target site," and "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

In an aspect, the disclosed methods can be used to introduce into plants polynucleotides useful for gene suppression of a target gene in a plant. Reduction of the activity of specific genes (also known as gene silencing, or gene suppression) is desirable for several aspects of genetic engineering in plants. Many techniques for gene silencing are well known to one of skill in the art, including but not limited to antisense technology.

In an aspect, the disclosed methods can be used to introduce into plants polynucleotides useful for the targeted integration of nucleotide sequences into a plant. For example, the disclosed methods can be used to introduce T-DNA expression cassettes comprising nucleotide sequences of interest flanked by non-identical recombination sites are used to transform a plant comprising a target site. In an aspect, the target site contains at least a set of non-identical recombination sites corresponding to those on the T-DNA expression cassette. The exchange of the nucleotide sequences flanked by the recombination sites is affected by a recombinase. Thus, the disclosed methods can be used for the introduction of T-DNA expression cassettes for targeted integration of nucleotide sequences, wherein the T-DNA expression cassettes which are flanked by non-identical recombination sites recognized by a recombinase that recognizes and implements recombination at the non-identical recombination sites. Accordingly, the disclosed methods and composition can be used to improve efficiency and speed of development of plants containing non-identical recombination sites.

Thus, the disclosed methods can further comprise methods for the directional, targeted integration of exogenous nucleotides into a transformed plant. In an aspect, the disclosed methods use novel recombination sites in a gene targeting system which facilitates directional targeting of desired genes and nucleotide sequences into corresponding recombination sites previously introduced into the target plant genome.

In an aspect, a nucleotide sequence flanked by two non-identical recombination sites is introduced into one or more cells of an explant derived from the target organism's genome establishing a target site for insertion of nucleotide sequences of interest. Once a stable plant or cultured tissue is established a second construct, or nucleotide sequence of interest, flanked by corresponding recombination sites as those flanking the target site, is introduced into the stably transformed plant or tissues in the presence of a recombinase protein. This process results in exchange of the nucleotide sequences between the non-identical recombination sites of the target site and the T-DNA expression cassette.

It is recognized that the transformed plant prepared in this manner may comprise multiple target sites; i. e., sets of non-identical recombination sites. In this manner, multiple manipulations of the target site in the transformed plant are available. By target site in the transformed plant is intended a DNA sequence that has been inserted into the transformed plant's genome and comprises non-identical recombination sites.

Examples of recombination sites for use in the disclosed method are known. The two-micron plasmid found in most naturally occurring strains of *Saccharomyces cerevisiae*, encodes a site-specific recombinase that promotes an inversion of the DNA between two inverted repeats. This inversion plays a central role in plasmid copy-number amplification.

The protein, designated FLP protein, catalyzes site-specific recombination events. The minimal recombination site (FRT) has been defined and contains two inverted 13-base pair (bp) repeats surrounding an asymmetric 8-bp spacer. The FLP protein cleaves the site at the junctions of the repeats and the spacer and is covalently linked to the DNA via a 3'phosphate. Site specific recombinases like FLP cleave and religate DNA at specific target sequences, resulting in a precisely defined recombination between two identical sites. To function, the system needs the recombination sites and the recombinase. No auxiliary factors are needed. Thus, the entire system can be inserted into and function in plant cells. The yeast FLP\FRT site specific recombination system has been shown to function in plants. To date, the system has been utilized for excision of unwanted DNA. See, Lyznik et at. (1993) Nucleic Acid Res. 21: 969-975. In contrast, the present disclosure utilizes non-identical FRTs for the exchange, targeting, arrangement, insertion and control of expression of nucleotide sequences in the plant genome.

In an aspect, a transformed organism of interest, such as an explant from a plant, containing a target site integrated into its genome is needed. The target site is characterized by being flanked by non-identical recombination sites. A targeting cassette is additionally required containing a nucleotide sequence flanked by corresponding non-identical recombination sites as those sites contained in the target site of the transformed organism. A recombinase which recognizes the non-identical recombination sites and catalyzes site-specific recombination is required.

It is recognized that the recombinase can be provided by any means known in the art. That is, it can be provided in the organism or plant cell by transforming the organism with an expression cassette capable of expressing the recombinase in the organism, by transient expression, or by providing messenger RNA (mRNA) for the recombinase or the recombinase protein.

By "non-identical recombination sites" it is intended that the flanking recombination sites are not identical in sequence and will not recombine or recombination between the sites will be minimal. That is, one flanking recombination site may be a FRT site where the second recombination site may be a mutated FRT site. The non-identical recombination sites used in the methods of the present disclosure prevent or greatly suppress recombination between the two flanking recombination sites and excision of the nucleotide sequence contained therein. Accordingly, it is recognized that any suitable non-identical recombination sites may be utilized in the present disclosure, including FRT and mutant FRT sites, FRT and lox sites, lox and mutant lox sites, as well as other recombination sites known in the art.

By suitable non-identical recombination site implies that in the presence of active recombinase, excision of sequences between two non-identical recombination sites occurs, if at all, with an efficiency considerably lower than the recombinationally-mediated exchange targeting arrangement of nucleotide sequences into the plant genome. Thus, suitable non-identical sites for use in the present disclosure include those sites where the efficiency of recombination between the sites is low; for example, where the efficiency is less than about 30 to about 50%, preferably less than about 10 to about 30%, more preferably less than about 5 to about 10%.

As noted above, the recombination sites in the targeting cassette correspond to those in the target site of the transformed plant. That is, if the target site of the transformed plant contains flanking non-identical recombination sites of FRT and a mutant FRT, the targeting cassette will contain the same FRT and mutant FRT non-identical recombination sites.

It is furthermore recognized that the recombinase, which is used in the disclosed methods, will depend upon the recombination sites in the target site of the transformed plant and the targeting cassette. That is, if FRT sites are utilized, the FLP recombinase will be needed. In the same manner, where lox sites are utilized, the Cre recombinase is required. If the non-identical recombination sites comprise both a FRT and a lox site, both the FLP and Cre recombinase will be required in the plant cell.

The FLP recombinase is a protein which catalyzes a site-specific reaction that is involved in amplifying the copy number of the two-micron plasmid of *S. cerevisiae* during DNA replication. FLP protein has been cloned and expressed. See, for example, Cox (1993) Proc. Natl. Acad. Sci. U.S.A 80: 4223-4227. The FLP recombinase for use in the present disclosure may be that derived from the genus *Saccharomyces*. It may be preferable to synthesize the recombinase using plant preferred codons for optimum expression in a plant of interest. See, for example, U.S. application Ser. No. 08/972,258 filed Nov. 18, 1997, entitled "Novel Nucleic Acid Sequence Encoding FLP Recombinase," herein incorporated by reference.

The bacteriophage recombinase Cre catalyzes site-specific recombination between two lox sites. The Cre recombinase is known in the art. See, for example, Guo et al. (1997) Nature 389: 40-46; Abremski et al. (1984) J. Biol. Chem. 259: 1509-1514; Chen et al. (1996) Somat. Cell Mol. Genet. 22: 477-488; and Shaikh et al. (1977) J. Biol. Chem. 272: 5695-5702. All of which are herein incorporated by reference. Such Cre sequence may also be synthesized using plant preferred codons.

Where appropriate, the nucleotide sequences to be inserted in the plant genome may be optimized for increased expression in the transformed plant. Where mammalian, yeast, or bacterial genes are used in the present disclosure, they can be synthesized using plant preferred codons for improved expression. It is recognized that for expression in monocots, dicot genes can also be synthesized using monocot preferred codons. Methods are available in the art for synthesizing plant preferred genes. See, for example, U.S. Pat. Nos. 5,380,831, 5,436,391, and Murray et al. (1989) Nucleic Acids Res. 17: 477-498, herein incorporated by reference. The plant preferred codons may be determined from the codons utilized more frequently in the proteins expressed in the plant of interest. It is recognized that monocot or dicot preferred sequences may be constructed as well as plant preferred sequences for particular plant species. See, for example, EPA 0359472; EPA 0385962; WO 91/16432; Perlak et al. (1991) Proc. Natl. Acad. Sci. USA, 88: 3324-3328; and Murray et al. (1989) Nucleic Acids Research, 17: 477-498. U.S. Pat. Nos. 5,380,831; 5,436,391; and the like, herein incorporated by reference. It is further recognized that all or any part of the gene sequence may be optimized or synthetic. That is, fully optimized or partially optimized sequences may also be used.

Additional sequence modifications are known to enhance gene expression in a cellular host and can be used in the present disclosure. These include elimination of sequences encoding spurious polyadenylation signals, exon-intron splice site signals, transposon-like repeats, and other such well-characterized sequences, which may be deleterious to gene expression. The G-C content of the sequence may be adjusted to levels average for a given cellular host, as calculated by reference to known genes expressed in the host cell. When possible, the sequence is modified to avoid predicted hairpin secondary RNA structures.

The present disclosure also encompasses novel FLP recombination target sites (FRT). The FRT has been identified as a minimal sequence comprising two 13 base pair repeats, separated by an eight (8) base spacer. The nucleotides in the spacer region can be replaced with a combination of nucleotides, so long as the two 13-base repeats are separated by eight nucleotides. It appears that the actual nucleotide sequence of the spacer is not critical; however, for the practice of the present disclosure, some substitutions of nucleotides in the space region may work better than others. The eight-base pair spacer is involved in DNA-DNA pairing during strand exchange. The asymmetry of the region determines the direction of site alignment in the recombination event, which will subsequently lead to either inversion or excision. As indicated above, most of the spacer can be mutated without a loss of function. See, for example, Schlake and Bode (1994) Biochemistry 33: 12746-12751, herein incorporated by reference.

Novel FRT mutant sites can be used in the practice of the disclosed methods. Such mutant sites may be constructed by PCR-based mutagenesis. Although mutant FRT sites are known (see SEQ ID Nos 2, 3, 4 and 5 of WO1999/025821), it is recognized that other mutant FRT sites may be used in the practice of the present disclosure. The present disclosure is not restricted to the use of a particular FRT or recombination site, but rather that non-identical recombination sites or FRT sites can be utilized for targeted insertion and expression of nucleotide sequences in a plant genome. Thus, other mutant FRT sites can be constructed and utilized based upon the present disclosure.

As discussed above, bringing genomic DNA containing a target site with non-identical recombination sites together with a vector containing a T-DNA expression cassette with corresponding non-identical recombination sites, in the presence of the recombinase, results in recombination. The nucleotide sequence of the T-DNA expression cassette located between the flanking recombination sites is exchanged with the nucleotide sequence of the target site located between the flanking recombination sites. In this manner, nucleotide sequences of interest may be precisely incorporated into the genome of the host.

It is recognized that many variations of the present disclosure can be practiced. For example, target sites can be constructed having multiple non-identical recombination sites. Thus, multiple genes or nucleotide sequences can be stacked or ordered at precise locations in the plant genome.

Likewise, once a target site has been established within the genome, additional recombination sites may be introduced by incorporating such sites within the nucleotide sequence of the T-DNA expression cassette and the transfer of the sites to the target sequence. Thus, once a target site has been established, it is possible to subsequently add sites, or alter sites through recombination.

Another variation includes providing a promoter or transcription initiation region operably linked with the target site in an organism. Preferably, the promoter will be 5' to the first recombination site. By transforming the organism with a T-DNA expression cassette comprising a coding region, expression of the coding region will occur upon integration of the T-DNA expression cassette into the target site. This aspect provides for a method to select transformed cells, particularly plant cells, by providing a selectable marker sequence as the coding sequence.

Other advantages of the present system include the ability to reduce the complexity of integration of transgenes or transferred DNA in an organism by utilizing T-DNA expression cassettes as discussed above and selecting organisms with simple integration patterns. In the same manner, preferred sites within the genome can be identified by comparing several transformation events. A preferred site within the genome includes one that does not disrupt expression of essential sequences and provides for adequate expression of the transgene sequence.

Epigenetics, the study of changes in organisms caused by modification of gene expression rather than alteration of the genetic code itself, can include analyses of DNA modifications such as 5-methylcytosine (5 mC) and 5-hydroxymethylcytosine (5 hmC), posttranslational histone tail modifications, energy dependent nucleosomal remodeling, and long non-coding RNA regulation of local chromatin structure and chromosomal organization.

These modifications of DNA and/or chromatin are of interest given the impact these modifications can have on gene expression, development, and ultimately genome stability. That patterns of histone-mediated chromatin remodeling, the so-called "histone code", coordinate such control, that can interact and at time be coordinated by DNA methylation patterns suggests a complex interplay of different epigenetic mechanisms together coordinate genome stability.

Epigenetic modifications of DNA or histone modifications can be established or removed by enzymes that catalyze particular modification ("writers"), proteins recognizing and binding to a modification ("readers"), and enzymes that remove certain modifications ("erasers").

Evidence for epigenetic regulation consistent with allele-specific of BABY BOOM in a tissue-specific manner, specifically including tassel tissues containing anthers and microspores, was previously demonstrated by Makarevitch et al. (Makarevitch et al., 2013. Plant Cell. March; 25: 780-793). These authors profiled trimethylation of histone H3 lysine 27 (H3K27me3), a histone modification associated with gene silencing that plays a critical role in regulating gene expression during plant and animal development (See also, Schuettengruber et al., 2007; Berr et al., 2011; Zheng and Chen, 2011).

H3K27me3 is catalyzed by polycomb group (PcG) proteins and is thought to regulate such developmental processes. The PcG genes were characterized using mutants failing to properly maintain a repressed state of gene expression for homeotic genes in *Drosophila melanogaster* (Simon, 1995) and a subset of PcG proteins can form Polycomb-repressive complex (PRC2) involved in catalyzing lysine methylation of histone H3. Many plant species have orthologs for the PRC2 genes (reviewed in Hennig and Derkacheva, 2009; Kohler and Hennig, 2010; Zheng and Chen, 2011) and likely encode the same function in plants (Schubert et al., 2006).

The maize (*Zea mays*) genome encodes three E(z) homologs: Mez1, Mez2, and Mez3 (Springer et al., 2002). Mez1 is an imprinted gene that is most closely related to the CURLY LEAF (CLF) gene from *Arabidopsis* (Haun et al., 2007). Mez2 and Mez3 are highly similar to each other (92% nucleotide identity), are located in colinear regions of the maize genome, and are likely paralogs resulting from the ancient allopolyploid event in maize (Springer et al., 2002).

Yu et al. 2008. identified two BRI1-EMS-SUPPRESSOR 1 (BES1)-interacting proteins, EARLY FLOWERING 6 (ELF6) and its homolog RELATIVE OF EARLY FLOWERING 6 (REF6), that are Jumonji N/C (JmjN/C) domain-containing proteins previously reported to regulate flowering time (see Plant Cell 16:2601-13). After confirming BES1 and ELF6/REF6 protein interactions using GST pull-down and BiFC (bimolecular fluorescence complementation) experiments, these authors furthermore demonstrated mutations in ELF6 or REF6 genes resulted in aberrant BR-related phenotypes, including impaired cell elongation and reduced expression of BR target genes, thus demonstrating BES1 recruits the ELF6 and REF6 transcriptional regulators to regulate target gene expression.

In 2011, Lu et al. (see Nat Genet. 43:715-9) further characterized the functional activity of REF6. These authors demonstrated overexpression of REF6 specifically demethylated di- and tri-methylation post-translational modifications at the lysine 27 residues of histone 3, here called H3K27me2 and H3K27me3, respectively, whereas no other histone modifications were reported using standard methods. To further characterize how demethylation of H3K27me2 and H3K27me3 modifications affected gene regulation, it was shown that several H3K27me3 target genes that are normally silent in *Arabidopsis* seedlings, such as the MADS-box floral organ identity genes AP1 (APETALA1), AP3 (APETALA3), PI (PISTILLATA), AG (AGAMOUS) and SEP3 (SEPALLATA3), were ectopically activated in *Arabidopsis* seedlings stably transformed with an REF6 overexpression transgene construct.

The results suggest that catalytic activity of H3K27me3 demethylation coupled with the deposition of activating histone modifications can be useful for cellular reprogramming resulting in active transcription from a silent, or repressed, regulatory state. One class of proteins useful for depositing activating histone modifications are histone acetyltransferases (HATs), enzymes using acetyl coenzyme A (CoA) to transfer an acetyl group to a substrate. It is therefore expected that combining such H3K27me3 demethylation activities and establishing histone acetylation modifications in a targeted, programmable manner can be useful for cellular reprogramming of plant cells.

Histone acetyltransferases (HATs) acetylate lysine residues of amino terminal histone tails, resulting in transcription activation and are grouped into at least four different families based on sequence conservation within the HAT domain.

The General Control Nonrepressed (Gcn5)-related N-acetyltransferases (GNAT) domain catalyzes the transfer of the acetyl from the CoA donor to a primary amine of the acceptor. The GNAT proteins share a domain composed of four conserved sequence motifs A-D [PMID: 9175471, PMID: 10940244]. The acetyltransferase/GNAT domain forms a structurally conserved fold of six to seven beta strands (B) and 4 helices (H) in the topology B1-H1-H2-B2-B3-B4-H3-B5-H4-B6, followed by a C-terminal strand which may be from the same monomer or contributed by another [PMID: 10940244, PMID: 15581578]. Motifs D (B2-B3), A (B4-H3) and B (B5-H4) are collectively called the HAT core [PMID: 10940244, PMID: 12527305, PMID: 15581578], while the N-terminal motif C (B1-H1) is less conserved.

The MYST family (named after the MOZ, Ybf2/Sas3, Sas2 and Tip60 proteins) mediates many biological functions including gene regulation, DNA repair, cell-cycle regulation and development [PMID: 21132344] and can acetylate non-histone substrates [PMID: 19303850]. The MYST-type HAT domain contains three regions: a central region associated with acetyl-CoA cofactor binding and catalysis in addition to flanking N- and C-terminal regions harboring respectively a C2HC-type zinc finger and a helix-turn-helix DNA-binding motif. The N- and C-terminal segments directly flanking the catalytic core are likely to play an important role in histone substrate binding [PMID: 11106757, PMID: 17925393].

The following examples are offered by way of illustration and not by way of limitation.

EXAMPLES

The aspects of the disclosure are further defined in the following Examples, in which parts and percentages are by weight and degrees are Celsius, unless otherwise stated. These Examples, while indicating aspects of the disclosure, are given by way of illustration only. From the above discussion and these Examples, one skilled in the art can ascertain the essential characteristics of the aspects of the disclosure, and without departing from the spirit and scope thereof, can make various changes and modifications of them to adapt to various usages and conditions. Thus, various modifications in addition to those shown and described herein will be apparent to those skilled in the art from the foregoing description. Such modifications are also intended to fall within the scope of the appended claims.

Example 1: Plasmids

See Table 4 for a description of plasmids useful in the present disclosure.

TABLE 4

| SEQ ID NO: | Plasmid | Plasmid Elements |
|---|---|---|
| 37 | RV010564 | RB + NOS PRO::WUS2::PINII TERM + UBIZM PRO::UBIZM 5UTR::UBIZM INTRON1::ZS-YELLOW N1::PINII TERM + UBIZM PRO::UBIZM 5UTR::UBIZM |

TABLE 4-continued

| SEQ ID NO: | Plasmid | Plasmid Elements |
|---|---|---|
| | | INTRON1::PMI::PINII TERM + OS-ACTIN PRO::OS-ACTIN INTRON1::MO-PAT::CAMV35 TERM + LB |
| 60 | pDAB135006 | OMEGA PRO::NcoI::KpnI CLONING SITE::OMEGA 3 UTR + F1 ORI + BLA |
| 132 | PHP97131 | RB + PV-EGG CELL PRO (TR1)_EGG MIN PRO::PV-PRO31696.1 5UTR::ZM-ODP2::PINII TERM + ZM-EXP31554.1 PRO-V1::SV40 NLS:CAS9 EXON1 (SP) (MO)::ST-LS1 INTRON2::CAS9 EXON2 (SP) (MO):VIRD2 NLS:6FRAME STOPS1::ZM-EGG TERM + ZM-U6 POLIII CHR8 PRO::ZM CHR1-53.66-45CR1 GUIDE RNA::ZM-U6 POLIII CHR8 TERM + UBI1ZM PRO::UBI1ZM 5UTR (PHI)::UBI1ZM INTRON1 (PHI)::DS-RED2 (TR1)::PINII TERM + PV-EGG CELL PRO (TR1)::EGG MIN PRO:PV-PRO31696.1 5UTR::MO-CRE EXON1::ST-LS1 INTRON2-V2::MO-CRE EXON2::PINII TERM + ZM CHR1-53.66-45CR1 TARGET SITE:ZM-SEQ158 + UBI1ZM PRO::UBI1ZM 5UTR (PHI)::UBI1ZM INTRON1 (PHI):FRT1_NPTII::PINII TERM + ZM-SEQ159:ZM CHR1-53.66-45CR1 TARGET SITE + LB |
| 133 | PHP87078 | RB + FMV ENH:PSCV ENH:MMV ENH:ZM-PLTP PRO::ZM-WUS2::IN2-1 TERM + SB-UBI PRO::ZS-GREEN1::OS-UBI TERM + LB |
| 134 | RV020636 (3XENH-3XEME-WUS) | RB + FMV ENH:PSCV ENH:MMV ENH:ZM-(3XEMEs)-PLTP PRO::ZM-WUS2::IN2-1 TERM + SB-UBI PRO::DSRED::OS-UBI TERM + LB |
| 135 | RV020636 + Genetic Chromosome Doubling | RB + FMV ENH::PSCV ENH::MMV ENH::ZM-(3XEMEs)-PLTP PRO::ZM-WUS2::IN2-1 TERM + SB-UBI PRO::DSRED::OS-UBI TERM + NOS PRO::FZR::SB-GKAF TERM + LB |
| 201 | PHP89615 (WUS2-C5) | ZM-U6 POLIII CHR8 PRO + ZM-WUS2-CR5:GUIDE RNA + ZM-U6 POLIII CHR8 TERM |
| 202 | PHP89614 (WUS2-C4) | ZM-U6 POLIII CHR8 PRO + ZM-WUS2-CR4:GUIDE RNA + ZM-U6 POLIII CHR8 TERM |
| 203 | PHP89613 (WUS2-C3) | ZM-U6 POLIII CHR8 PRO + ZM-WUS2-CR3:GUIDE RNA + ZM-U6 POLIII CHR8 TERM |
| 204 | PHP89612 (WUS2-C2) | ZM-U6 POLIII CHR8 PRO + ZM-WUS2-CR2:GUIDE RNA + ZM-U6 POLIII CHR8 TERM |
| 205 | PHP89611 (WUS2-C1) | ZM-U6 POLIII CHR8 PRO + ZM-WUS2-CR1:GUIDE RNA + ZM-U6 POLIII CHR8 TERM |
| 206 | RV038531 | UBI1ZM PRO::UBI1ZM 5UTR:UBI1ZM INTRON1:CSY4(MO):PINII TERM + UBI1ZM PRO::UBI1ZM 5UTR:UBI1ZM INTRON1:ZS-YELLOW1:PINII TERM + ZM-U6 POLIII CHR8 PRO::CSY4 RS:ZM-ODP2-CR2:GUIDE RNA:CSY4 RS:ZM-ODP2-CR3:GUIDE RNA:CSY4 RS:ZM-ODP2-CR4:GUIDE RNA:CSY4 RS:ZM-ODP2-CR3:GUIDE RNA:CSY4 RS:ZM-ODP5-CR2:GUIDE RNAUSY4 RS:ZM-ODP2-CR3:GUIDE RNA:CSY4 RS:ZM-ODP2-CR6:GUIDE RNA:CSY4 RS:ZM-ODP2-CR3:GUIDE RNA:CSY4 RS:ZM-ODP2-CR2:GUIDE RNA:CSY4 RS:ZM-ODP2-CR7:GUIDE RNA:CSY4 RS(2X)::ZM-U6 POLIII CHR8 TERM |
| 210 | RV038874 | UBI1ZM PRO::UBI1ZM 5UTR (PHI) + UBI1ZM INTRON1 (PHI) + ZM-ODP2 + NOS PRO::ZM-WUS2 + PINII TERM + UBI1ZM PRO::UBI1ZM 5UTR (PHI) + UBI1ZM INTRON1 (PHI) + DS-RED2 + PINII TERM + ATTL3 + KAN + PUC ORI + ATTR2 |
| 399 | RV028329 | RB + BUFFER1 + MINI-ALLSTOPS3 + PSA2 + ATTB4 + NOS PRO (ALT1) + TET OP1 (PHI) + ZM-WUS2 (CDNA) ORIGINAL (TR2) + PINII TERM + ATTB1 + UBI1ZM PRO (TR2) + TET OP1 (PHI) + TET OP1 (PHI) + TET OP1 (PHI) + UBI1ZM 5UTR (PHI) + SB-UBI INTRON1 + ZM-ODP2 + PINII TERM + ATTB2 + GZ-W64A TERM-V17 + UBI1ZM PRO + UBI1ZM 5UTR (PHI) + UBI1ZM INTRON1 (PHI) + ESR (L15-20) + PINII TERM + SB-ALS PRO + ZM-ALS (HRA) (TR1) + PINII TERM + ATTB3 + SB-AKAF (B1) |

TABLE 4-continued

| SEQ ID NO: | Plasmid | Plasmid Elements |
|---|---|---|
| 400 | RV028330 | TERM + UBI1ZM PRO-V6 + UBI1ZM 5UTR (PHI) + UBI1ZM INTRON1 + LOXP + GZ-W64A TERM-V8 + FL2 TERM (ALT1) + ZM-AXIG1 1.3KB PRO-V1 + ZM-WUS2 (ALT1) + IN2-1 TERM + ZM-PLTP PRO + ZM-PLTP 5 UTR + ZM-ODP2 (ALT1) + OS-T28 TERM + GLB1 PRO (ALT1) + MO-CRE EXON1 + ST-LS1 INTRON2-V2 + MO-CRE EXON2 + GLB1 TERM (ALT1) + LOXP + PMI (SYN) + PINII TERM + OS-ACTIN PRO + OS-ACTIN INTRON1 (MOD1) + MO-PAT (MOD1) + CAMV35S TERM + FRT87 + PSB1 + MINI-ALLSTOPS + MINI-ALLSTOPS4 + LB |
| 401 | RV034409 | RB + BUFFER1 + MINI-ALLSTOPS3 + PSA2 + ATTB4 + NOS PRO (ALT1) + TET OP1 (PHI) + ZM-WUS2 (CDNA) ORIGINAL (TR2) + PINII TERM + ATTB1 + UBI1ZM PRO (TR2) + TET OP1 (PHI) + TET OP1 (PHI) + TET OP1 (PHI) + UBI1ZM 5UTR (PHI) + SB-UBI INTRON1 + ZM-ODP2 + PINII TERM + CAMV35S PRO (PHI) + TET OP1 (PHI) + TET OP1 (PHI) + TET OP1 (PHI) + OMEGA 5UTR + ADH1 INTRON1 + ZM-CYCD2 + PINII TERM + ATTB2 + GZ-W64A TERM-V17 + UBI1ZM PRO + UBI1ZM 5UTR (PHI) + UBI1ZM INTRON1 (PHI) + ESR (L15-20) + PINII TERM + SB-ALS PRO + ZM-ALS (HRA) (TR1) + PINII TERM + ATTB3 + SB-AKAF (B1) TERM + UBI1ZM PRO-V6 + UBI1ZM 5UTR (PHI) + UBI1ZM INTRON1 + LOXP + GZ-W64A TERM-V8 + FL2 TERM (ALT1) + ZM-AXIG1 1.3KB PRO-V1 + ZM-WUS2 (ALT1) + IN2-1 TERM + ZM-PLTP PRO + ZM-PLTP 5 UTR + ZM-ODP2 (ALT1) + OS-T28 TERM + GLB1 PRO (ALT1) + MO-CRE EXON1 + ST-LS1 INTRON2-V2 + MO-CRE EXON2 + GLB1 TERM (ALT1) + LOXP + PMI (SYN) + PINII TERM + OS-ACTIN PRO + OS-ACTIN INTRON1 (MODI) + MO-PAT (MOD1) + CAMV35S TERM + FRT87 + PSB1 + MINI-ALLSTOPS + MINI-ALLSTOPS4 + LB |
| 410 | PHP97202 | RB + PV-EGG CELL PRO (TR1)::PV-PRO31696.1 5UTR::EGG MIN PRO::ZM-ODP2::PINII TERM + ZM-EXP31554.4 PRO-V1::SV40 NLs::CAS9 EXON1 (SP) (MO)::ST-LS 1 INTRON2::CAS9 EXON2 (SP) (MO)::VIRD2 NLS::6FRAME STOP S1::ZM-EGG TERM + ZM-U6 POLIII CHR8 PRO::ZM-NAC7-CR5: WIDE RNA::ZM-U6 POLIII CHR8 TERM + ZM-U6 POLIII CHR8 PRO::ZM-NAC7-CR5: WIDE RNA::ZM-U6 POLIII CHR8 TERM + UBI1ZM PRO::UBI1ZM 5UTR (PHI)::UBI1ZM INTRON1 (PHI)::DS-RED2 (TR1)::PINII TERM + PV-EGG CELL PRO (TR1)::PV-PRO31696.1 5UTR::EGGMIN PRO::MO-CRE EXON1::ST-LS1 INTRON2-V2::MO-CRE EXON2::PINII TERM + UBI1ZM PRO::UBI1ZM 5UTR (PHI)::UBI1ZM INTRON1 (PHI)::NPTII::PINII TERM + LB |
| 411 | PHP97330 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ZM-PLTP PRO::ZM-PLTP 5 UTR::ZM-ODP2 (ALT1)::OS-T28 TERM::PINII TERM::CZ19B1 TERM + ZM-GLB1 PRO::MO-CRE EXON1:: ST-LS 1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ST-LS1 INTRON2-V3 FRAG2::ZM-ALS (HRA) EXON2::SB-PEPC1 TERM (MOD1) + PV-EGG CELL PRO (TR1):UGG MIN PRO::PV-PRO31696.1 5UTR::SV40 NLS:CAS9 EXON1 (SP) (MO)::ST-LS 1 INTRON2::CAS9 EXON2 (SP) (MO):VIRD2 NLS (TR2):30XQ-V2:AT-CBF1A (MO1) (TR1)::PINII TERM + ZM-U6 POLIII CHR8 PRO::ZM-ODP2-CR1:GUIDE RNA::ZM-U6 POLIII CHR8 TERM + LB |
| | | RB + MINI-ALLSTOPS3 + PSA2 + SB-ALS PRO::ZM-ALS (HRA) EXON1::ST-LS 1 INTRON2 FRAG1 + LOXP + ZM-AXIG1 1XOP-B PRO- |

TABLE 4-continued

| SEQ ID NO: | Plasmid | Plasmid Elements |
|---|---|---|
| | | V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1:: ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ST-LS1 INTRON2-V3 FRAG2::ZM-ALS (HRA) EXON2::SB-PEPC1 TERM (MOD1) + ATTB4 + PV-EGG CELL PRO (TR1): UGG MIN PRO::PV-PRO31696.1 5UTR::SV40 NLS:CAS9 EXON1 (SP) (MO)::ST-LS 1 INTRON2::CAS9 EXON2 (SP) (MO): VIRD2 NLS (TR2):30XQ-V2:AT-CBF1A (MO1) (TR1)::PINII TERM + UBI1ZM PRO::UBI1ZM 5UTR (PHI)::UBI1ZM INTRON1 (PHI)::CSY4 (MO)::PINII TERM + ZM-U6 POLIII CHR8 PRO:CSY4 RS:ZM-ODP2-CR1:GUIDE RNA:CSY4 RS:ZM-WUS2-CR5:GUIDE RNA:CSY4 RS:ZM-LEC1-CR1:GUIDE RNA:CSY4 RS:CSY4 RS::ZM-U6 POLIII CHR8 TERM + LB |
| 412 | PHP97566 | RB + MINI-ALLSTOPS3 + PSA2 + SB-ALS PRO::ZM-ALS (HRA) EXON1::ST-LS 1 INTRON2 FRAG1 + LOXP + ZM-AXIG1 1XOP-B PRO-VE :ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CRE EXON2::PINII TERM-V3 + SB-UBI PRO::SB-UBI INTRON1::ZS-GREEN1::OS-UBI TERM + MINI-ALLSTOPS + LOXP + ST-LS1 INTRON2-V3 FRAG2::ZM-ALS (HRA) EXON2::SB-PEPC1 TERM (MOD1) + ATTB4 + PV-EGG CELL PRO (TR1):UGG MIN PRO::PV-PRO31696.1 5UTR:SV40 NLS:CAS9 EXON1 (SP) (MO):ST-LS 1 INTRON2:CAS9 EXON2 (SP) (MO):VIRD2 NLS (TR2):30XQ-V2:AT-CBF1A (MO1) (TR1)::PINII TERM + UBI1ZM PRO::UBI1ZM 5UTR (PHI)::UBI1ZM INTRON1 (PHI)::CSY4 (MO)::PINII TERM + ZM-U6 POLIII CHR8 PRO::CSY4 RS:ZM-ODP2-CR1:GUIDE RNA:CSY4 RS :ZM-WUS2-CR5:GUIDE RNA:CSY4 RS:ZM-LEC1-CR1:GUIDE RNA:CSY4 RS:ZM-CYCD2-CR1:GUIDE RNA:CSY4 RS:CSY4 RS::ZM-U6 POLIII CHR8 TERM + LB |
| 413 | PHP97203 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1:: ST-LS1 INTRON2-V2::MO-CRE EXON2::PINII TERM-V3 + SB-UBI PRO::SB-UBI INTRON1::ZS-GREEN1: OS-UBI TERM + MINI-ALLSTOPS + LOXP + ST-LS1 INTRON2-V3 FRAG2::ZM-ALS (HRA) EXON2::SB-PEPC1 TERM (MOD1) + ATTB4 + PV-EGG CELL PRO (TR1)::EGG MIN PRO::PV-PRO31696.1 5UTR::SV40 NLS:CAS9 EXON1 (SP) (MO)::ST-LS 1 INTRON2::CAS9 EXON2 (SP) (MO)::VIRD2 NLS (TR2):30XQ-V2:ZM-HAT2 (TR1)::PINII TERM + ZM-U6 POLIII CHR8 PRO::ZM-ODP2-CR1:GUIDE RNA::ZM-U6 POLIII CHR8 TERM + LB |
| 414 | PHP97388 | RB + SB-ALS PRO + ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ZM-GLB1 PRO::MO-CRE EXON1::ST-LS1 INTRON2-V2::MO-CRE EXON2 + ATTB2 + PINII TERM-V3 + SB-UBI PRO::SB-UBI INTRON1::ZS-GREEN1:OS-UBI TERM + LOXP + ST-LS 1 INTRON2-V3 FRAG2::ZM-ALS (HRA) EXON2::SB-PEPC1 TERM (MOD1) + PV-EGG |

TABLE 4-continued

| SEQ ID NO: | Plasmid | Plasmid Elements |
|---|---|---|
| 415 | PHP97331 | CELL PRO (TR1)::EGG MIN PRO::PV-PRO31696.1 5UTR::SV40 NLS:CAS9 EXON1 (SP) (MO)::ST-LS 1 INTRON2::CAS9 EXON2 (SP) (MO):VIRD2 NLS (TR2):30XQ-V2:ZM-HAT2 (TR1)::PINII TERM + UBI1ZM PRO::UBI1ZM 5UTR (PHI)::UBI1ZM INTRON1 (PHI)::CSY4 (MO)::PINII TERM + ZM-U6 POLIII CHR8 PRO::CSY4 RS:ZM-ODP2-CR1:GUIDE RNA:CSY4 RS:ZM-WUS2-CR5:GUIDE RNA:CSY4 RS:ZM-LEC1-CR1:GUIDE RNA:CSY4 RS:CSY4 RS::ZM-U6 POLIII CHR8 TERM + LB RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO:MO-CRE EXON1::ST-LS1 INTRON2-V2::MO-CREEXON2::PINII TERM-V3 + SB-UBI PRO::SB-UBI INTRON1::ZS-GREEN1: OS-UBI TERM + MINI-ALLSTOPS + LOXP + ST-LS 1 INTRON2-V3 FRAG2::ZM-ALS (HRA) EXON2::SB-PEPC1 TERM (MOD1) + ATTB4 + PV-EGG CELL PRO (TR1)::EGG MIN PRO::PV-PRO31696.1 5UTR::SV40 NLS:CAS9 EXON1 (SP) (MO)::ST-LS 1 INTRON2::CAS9 EXON2 (SP) (M0):VIRD2 NLS (TR2):30XQ-V2:ZM-HAT2 (TR1)::PINII TERM + UBI1ZM PRO::UBI1ZM 5UTR (PHI)::UBI1ZM INTRON1 (PHI)::CSY4 (MO)::PINII TERM + ZM-U6 POLIII CHR8 PRO::CSY4 RS:ZM-ODP2-CR1:GUIDE RNA:CSY4 RS :ZM-WUS2-CR5:GUIDE RNA:CSY4 RS:ZM-LEC1-CR1:GUIDE RNA:CSY4 RS:ZM-CYCD2-CR1:GUIDE RNA:CSY4 RS:CSY4 RS::ZM-U6 POLIII CHR8 TERM + LB |
| 416 | PHP94831 | RB + SB-ALS PRO::ZM-ALS (HRA) EXON1::ST-LS1 INTRON2 FRAG1 + LOXP + ZM-AXIG1 1XOP-B PRO-V1::ZM-WUS2 (CDNA)::IN2-1 TERM + AT-5-IV-2 INS + ATTB1 + ZM-PLTP PRO::ZM-PLTP 5 UTR::ZM-ODP2 (ALT1)::OS-T28 TERM::PINII TERM::CZ19B1 TERM + ALL STOPS2 + ZM-GLB1 PRO::MO-CRE EXON1::ST-LS1 INTRON2-V2::MO-CREEXON2::PINII TERM-V3 + SB-UBI PRO::SB-UBI INTRON1::ZS-GREEN1: OS-UBI TERM + MINI-ALLSTOPS + LOXP + ST-LS 1 INTRON2-V3 FRAG2::ZM-ALS (HRA) EXON2::SB-PEPC1 TERM (MOD1) + ATTB4 + PV-EGG CELL PRO (TR1): UGG MIN PRO::PV-PRO31696.1 5UTR::SV40 NLS:CAS9 EXON1 (SP) (MO)::ST-LS 1 INTRON2::CAS9 EXON2 (SP) (MO)::VIRD2 NLS (TR2):30XQ-V2:ZM-HAT2 (TR1)::PINII TERM + ZM-U6 POLIII CHR8 PRO::ZM-ODP2-CR1:GUIDE RNA::ZM-U6 POLIII CHR8 TERM + LB |

Example 2: Culture Media

See Table 5 for a description of media formations for transformation, selection and regeneration useful in the methods of the present disclosure.

TABLE 5

| Medium components | Units per liter | 12R | 810K | 700A | 7101 |
|---|---|---|---|---|---|
| MS BASAL SALT MIXTURE | g | | | 4.3 | 4.3 |
| N6 BASAL SALTS | g | | | | |
| N6 MACRONUTRIENTS 10X | ml | | | | |
| POTASSIUM NITRATE | g | | | | |
| B5H MINOR SALTS 1000X | ml | | | | |
| NaFe EDTA FOR B5H 100X | ml | | | | |
| ERIKSSON'S VITAMINS 1000X | ml | | | | |
| S&H VITAMIN STOCK 100X | ml | | | | |
| THIAMINE HCL | mg | | | 10.0 | 10.0 |
| L-PROLINE | g | | | | 0.7 |
| CASEIN HYDROLYSATE (ACID) | g | | | | |
| SUCROSE | g | | | 68.5 | 20.0 |
| GLUCOSE | g | 5.0 | | 36.0 | 10.0 |
| 2,4-D | mg | | | 1.5 | 2.0 |
| AGAR | g | 15.0 | | | 8.0 |
| BACTO-AGAR | g | | 15.0 | | |
| DICAMBA | g | | | | |
| SILVER NITRATE | mg | | | | |

TABLE 5-continued

| Medium components | Units | | |
|---|---|---|---|
| AGRIBIO Carbenicillin | mg | | |
| Timentin | mg | | |
| Cefotaxime | mg | | |
| MYO-INOSITOL | g | 0.1 | 0.1 |
| NICOTINIC ACID | mg | 0.5 | 0.5 |
| PYRIDOXINE. HCL | mg | 0.5 | 0.5 |
| VITAMIN ASSAY CASAMINO ACIDS | g | 1.0 | |
| MES BUFFER | g | | 0.5 |
| ACETOSYRINGONE | uM | | 100.0 |
| ASCORBIC ACID 10 MG/ML (7S) | mg | | 10.0 |
| MS VITAMIN STOCK SOL. | ml | | |
| ZEATIN | mg | | |
| CUPRIC SULFATE | mg | | |
| IAA 0.5 MG/ML (28A) | ml | | |
| ABA 0.1 mm | ml | | |
| THIDIAZURON | mg | | |
| AGRIBIO Carbenicillin | mg | | |
| BAP | mg | | |
| YEAST EXTRACT (BD Difco) | g | 5.0 | |
| PEPTONE | g | 10.0 | |
| SODIUM CHLORIDE | g | 5.0 | |
| SPECTINOMYCIN | mg | 50.0 | 50.0 |
| FERROUS SULFATE. 7H20 | ml | 2.0 | |
| AB BUFFER 20X (12D) | ml | 50.0 | |
| AB SALTS 20X (12E) | ml | 50.0 | |
| THYMIDINE | mg | 50.0 | 50.0 | 50.0 |
| GENTAMYCIN | mg | 50.0 | 50.0 |
| MEROPENEM | mg | | |
| pH | | 6.8 | 5.2 | 5.8 |

| Medium components | Units per liter | 605J | 605B | 562V | 289Q |
|---|---|---|---|---|---|
| MS BASAL SALT MIXTURE | g | 4.3 | 4.3 | | 4.3 |
| N6 BASAL SALTS | g | | | 4.0 | |
| N6 MACRONUTRIENTS 10X | ml | 60.0 | 60.0 | | |
| POTASSIUM NITRATE | g | 1.7 | 1.7 | | |
| B5H MINOR SALTS 1000X | ml | 0.6 | 0.6 | | |
| NaFe EDTA FOR B5H 100X | ml | 6.0 | 6.0 | | |
| ERIKSSON'S VITAMINS 1000X | ml | 0.4 | 0.4 | 1.0 | |
| S&H VITAMIN STOCK 100X | ml | 6.0 | 6.0 | | |
| THIAMINE HCL | mg | 0.5 | 0.5 | 0.5 | |
| L-PROLINE | g | 2.0 | 2.0 | 0.69 | 0.7 |
| CASEIN HYDROLYSATE (ACID) | g | 0.3 | 0.3 | | |
| SUCROSE | g | 20.0 | 20.0 | 30.0 | 60.0 |
| GLUCOSE | g | 0.6 | 0.6 | | |
| 2,4-D | mg | 0.8 | 0.8 | 2.0 | |
| AGAR | g | 6.0 | 6.0 | 8.0 | 8.0 |
| BACTO-AGAR | g | | | | |
| DICAMBA | g | 1.2 | 1.2 | | |
| SILVER NITRATE | mg | 3.4 | 3.4 | 0.85 | |
| AGRIBIO Carbenicillin | mg | 100.0 | | | |
| Timentin | mg | | | | 150.0 |
| Cefotaxime | mg | | | | 100.0 |
| MYO-INOSITOL | g | | | | 0.1 |
| NICOTINIC ACID | mg | | | | |
| PYRJDOXINE.HCL | mg | | | | |
| VITAMIN ASSAY CASAMINO ACIDS | g | | | | |
| MES BUFFER | g | | | | |
| ACETOSYRINGONE | uM | | | 100.0 | |
| ASCORBIC ACID 10 MG/ML (7S) | mg | | | | |
| MS VITAMIN STOCK SOL. | ml | | | | 5.0 |
| ZEATIN | mg | | | | 0.5 |
| CUPRIC SULFATE | mg | | | | 1.3 |
| IAA 0.5 MG/ML (28A) | ml | | | | 2.0 |
| ABA 0.1 mm | ml | | | | 1.0 |
| THIDIAZURON | mg | | | | 0.1 |
| AGRIBIO Carbenicillin | mg | | | | 100.0 |
| BAP | mg | | | | 1.0 |
| YEAST EXTRACT (BD Difco) | g | | | | |
| PEPTONE | g | | | | |
| SODIUM CHLORIDE | g | | | | |
| SPECTINOMYCIN | mg | | | | |
| FERROUS SULFATE.7H20 | ml | | | | |
| AB BUFFER 20X (12D) | ml | | | | |
| AB SALTS 20X (12E) | ml | | | | |
| THYMIDINE | mg | | | 50.0 | |
| GENTAMYCIN | mg | | | | |
| MEROPENEM | mg | | 10.0 | | |
| pH | | 5.8 | 5.8 | 5.8 | 5.6 |

Example 3: *Agrobacterium*-Mediated Transformation of Corn

A. Preparation of *Agrobacterium* Master Plate.

*Agrobacterium tumefaciens* harboring a binary donor vector was streaked out from a −80° C. frozen aliquot onto solid 12R medium and cultured at 28° C. in the dark for 2-3 days to make a master plate.

B. Growing *Agrobacterium* on Solid Medium.

A single colony or multiple colonies of *Agrobacterium* were picked from the master plate and streaked onto a second plate containing 810K medium and incubated at 28° C. in the dark overnight. *Agrobacterium* infection medium (700A; 5 ml) and 100 mM 3'-5'-Dimethoxy-4'-hydroxyacetophenone (acetosyringone; 5 µL) were added to a 14-mL conical tube in a hood. About 3 full loops of *Agrobacterium* from the second plate were suspended in the tube and the tube was then vortexed to make an even suspension. The suspension (1 ml) was transferred to a spectrophotometer tube and the optical density (550 nm) of the suspension was adjusted to a reading of about 0.35-1.0. The *Agrobacterium* concentration was approximately 0.5 to $2.0 \times 10^9$ cfu/mL. The final *Agrobacterium* suspension was aliquoted into 2 mL microcentrifuge tubes, each containing about 1 mL of the suspension. The suspensions were then used as soon as possible.

C. Growing *Agrobacterium* on Liquid Medium.

Alternatively, *Agrobacterium* can be prepared for transformation by growing in liquid medium. One day before infection, a 125-ml flask is prepared with 30 ml of 557A medium (10.5 g/l potassium phosphate dibasic, 4.5 g/l potassium phosphate monobasic anhydrous, 1 g/l ammonium sulfate, 0.5 g/l sodium citrate dehydrate, 10 g/l sucrose, 1 mM magnesium sulfate) and 30 µL spectinomycin (50 mg/mL) and 30 µL acetosyringone (20 mg/mL). A half loopful of *Agrobacterium* from a second plate is suspended into the flasks and placed on an orbital shaker set at 200 rpm and incubated at 28° C. overnight. The *Agrobacterium* culture is centrifuged at 5000 rpm for 10 min. The supernatant is removed and the *Agrobacterium* infection medium (700A) with acetosyringone solution is added to the pellet. The *Agrobacterium* is resuspended by vortex and the optical density (550 nm) of the *Agrobacterium* suspension is adjusted to a reading of about 0.35 to 1.0.

D. Maize Transformation.

Ears of a maize (*Zea mays* L.) cultivar were surface-sterilized for 15-20 min in 20% (v/v) bleach (5.25% sodium hypochlorite) plus 1 drop of Tween 20 followed by 3 washes in sterile water. Immature embryos (IEs) were isolated from ears and were placed in 2 ml of the *Agrobacterium* 700A infection medium with acetosyringone solution. The optimal size of the embryos varies based on the inbred, but for transformation with the embryogeneis factors listed in Table 6 and/or the WUS2 and/or ODP2 developmental genes a wide size range of immature embryo sizes could be used. The *Agrobacterium* infection medium (700A) was drawn off and 1 ml of the *Agrobacterium* suspension was added to the embryos and the tube was vortexed for 5-10 sec. The microfuge tube was incubated for 5 min in the hood. The suspension of *Agrobacterium* and embryos were poured onto 710I (or 562V) co-cultivation medium (see Table 5). Any embryos left in the tube were transferred to the plate using a sterile spatula. The *Agrobacterium* suspension was drawn off and the embryos were placed axis side down on the media. The plate was incubated in the dark at 21° C. for 1-3 days of co-cultivation and embryos were then transferred to resting medium (605B medium) without selection.

Example 4: Method for Improved Transformation of Corn

The following experiments demonstrated that delivery of a T-DNA containing an embryogenesis factor operably linked to a strong, tissue-preferred promoter and a morphogenic developmental gene operably linked to a weak, constitutive promoter improved somatic embryogenesis in comparison to a T-DNA containing only a morphogenic developmental gene operably linked to a weak, constitutive promoter.

Two series of experiments were conducted. Each series compared two plasmids which were used to evaluate the cellular reprogramming effects on treated immature embryos as measured by callus induction and a somatic embryogenesis response over a period of 7 to 10 days.

Expression cassettes containing each embryogenesis factor namely, each embryogenesis factor DNA polynucleotide (SEQ ID NOS:1-16) encoding each embryogenesis factor polypeptide (SEQ ID NOS: 17-32), respectively (see Table 6), operably linked to a strong, tissue-preferred promoter were synthesized and used for experimental treatments. This embryogenesis expression cassette was used for experimental treatments as described below. An expression cassette containing a morphogenic developmental gene operably linked to a weak, constitutive promoter was synthesized and used with the embryogenesis expression cassette for experimental treatments as described below. An experimental control treatment containing sequences of the same morphogenic developmental gene operably linked to the same weak, constitutive promoter was also used as described below.

TABLE 6

| Embryogenesis Factor | Gene Identifier | Gene Description | DNA SEQ ID NO: | Peptide SEQ ID NO: |
|---|---|---|---|---|
| 1 | dpzm02g056660.1.1 | Transcription factor bHLH30-like protein | 1 | 17 |
| 2 | dpzm05g068750.1.1 | Hybrid D-type cyclin | 2 | 18 |
| 3 | dpzm02g055960.1.1 | Mitogen-activated protein kinase protein | 3 | 19 |
| 4 | dpzm03g050950.1.1 | Plant lipid transfer protein | 4 | 20 |
| 5 | dpzm07g031470.1.1 | Cyclin delta-2 | 5 | 21 |
| 6 | dpzm05g059760.1.1 | OBERON-like protein-like protein | 6 | 22 |
| 7 | dpzm05g024290.1.1 | Polynucleotide adenylyltransferase | 7 | 23 |
| 8 | dpzm08g019790.1.1 | GATA zinc finger protein | 8 | 24 |
| 9 | dpzm01g054380.1.1 | Homeobox-leucine zipper protein | 9 | 25 |
| 10 | dpzm02g002440.1.1 | Hydrolase | 10 | 26 |
| 11 | dpzm09g039270.1.1 | Telomerase reverse transcriptase | 11 | 27 |
| 12 | dpzm10g007430.1.1 | Zinc finger protein | 12 | 28 |
| 13 | dpzm01g090680.1.1 | GRAS family transcription factor | 13 | 29 |
| 14 | dpzm04g062820.1.1 | barley mlo defense gene homolog4 | 14 | 30 |
| 15 | dpzm01g079120.1.1 | 3-ketoacyl-CoA synthase 11-like protein | 15 | 31 |
| 16 | dpzm09g028300.1.1 | Phytosulfokine | 16 | 32 |

In a first series of experiments, a first plasmid was used as an experimental treatment and contained three expression cassettes, comprising; i.) ZM-PLTP PRO::ZM-PLT 5UTR::(cloning site; for insertion of each embryogenesis factor)::OS-T28 TERM, ii.) NOS PRO::ZM-WUS2::PINII TERM, and iii.) UBIZM PRO::UBIZM 5UTR::UBIZM INTRON1::DS-RED2::PINII TERM. For each embryogenesis factor shown in Table 6, each synthesized gene fragment included flanking sequences encoding compatible restriction sites, typically BamHI and KpnI recognition motifs. These restriction sites allowed each embryogenesis factor (SEQ ID NOS: 1-16) to be directionally cloned into the cloning site of the expression cassette operably linked to a PLTP regulatory element described in i.) above. Exemplary sequences are provided, including polynucleotides encoding the ZM-PLTP PRO::ZM-PLT 5UTR (SEQ ID NO: 33), the OS-T28 TERM (SEQ ID NO: 34), the expression cassette NOS PRO::ZM-WUS2::PINII TERM (SEQ ID NO: 35), and the expression cassette UBIZM PRO::UBIZM 5UTR::UBIZM INTRON 1::DS-RED2::PINII TERM (SEQ ID NO: 36).

A plasmid used as the experimental control treatment, RV010564 (SEQ ID NO: 37), contains a T-DNA comprising the following components; RB+NOS PRO::WUS2::PINII TERM+UBIZM PRO::UBIZM 5UTR::UBIZM INTRON1::ZS-YELLOW N1::PINII TERM+UBIZM PRO::UBIZM 5UTR::UBIZM INTRON1::PMI:PINII TERM+OS-ACTIN PRO::OS-ACTIN INTRON1::MO-PAT::CAMV35 TERM+LB.

The experimental control treatment using RV010564 (SEQ ID NO: 37) was not sufficient to result in a high level of somatic embryogenesis in treated plant cells. This experimental control treatment expression cassette was designed to allow treated cells to only be poised, or reprogrammed nearly to an equilibrium sufficient for embryogenesis, yet not independently sufficient for inducing embryogenesis. Accordingly, use of the tissue-preferred PLTP promoter regulating expression of each embryogenesis factor was therefore expected to be useful for evaluating a cellular reprograming response relative to the baseline observed using the experimental control treatment.

Using a similar strategy, a second series of experiments was performed using a second plasmid as an experimental treatment containing three expression cassettes, comprising; i.) ZM-PLTP PRO::ZM-PLT 5UTR::(cloning site; for transfer of a polynucleotide encoding an embryogenesis factor; see SEQ ID NOS: 1-16)::OS-T28 TERM, ii.) UBIZM PRO::UBIZM 5UTR::UBIZM INTRON1::ZM-ODP2::PINII TERM, and iii.) UBIZM PRO::UBIZM 5UTR::UBIZM INTRON1::DS-RED2::PINII TERM. Exemplary sequences include polynucleotides encoding ZM-PLTP PRO::ZM-PLT 5UTR (SEQ ID NO: 33), OS-T28 TERM (SEQ ID NO: 34), UBIZM PRO::UBIZM 5UTR::UBIZM INTRON1::ZM-ODP2::PINII TERM (SEQ ID NO: 38), and UBIZM PRO::UBIZM 5UTR::DS-RED2::PINII TERM (SEQ ID NO: 36).

Each embryogenesis factor shown in Table 6 was evaluated using the two plasmid entries described above by transforming embryos (1.8 mm average length) isolated from the same donor ear, thereby accounting for variation in donor ear quality. The isolated embryos were divided into two groups with each group being treated by the experimental treatment or the experimental control treatment for each series, with comparisons relative to a WUSCHEL polypeptide in one series and comparisons relative to Ovule Development Protein 2 (ODP2) polypeptide in a second series.

Briefly, tissue culture was performed by culturing infected embryos using co-cultivation (710I or 562V) medium for 24 hours at 21° C. under dark conditions after incubating 5 minutes at room temperature using 700A medium. The treated embryos were transferred to resting (605B) medium for 7 to 11 days at 28° C. under dark conditions.

Relative efficacy of somatic embryogenesis was computed by scoring the percent of responsive embryos exhibiting a callus induction phenotype at 7 days after infection and further somatic embryogenesis development at 14 days after infection in response to both the experimental treatments and the experimental control treatment. The ratio of the percentage of embryos scored with a reprogrammed cell fate in response to the experimental treatments was divided by the percentage of embryos scored with a reprogrammed cell fate in response to the experimental control treatments to compute the relative efficacy of somatic embryogenesis induction (shown as EF+WUS/WUS alone or EF+BBM/BBM alone; see FIG. 1) for each embryogenesis factor. Co-expression of DsRED protein expression within proliferating cells was also evaluated using an epi-fluorescent microscope to confirm the presence of T-DNA containing each embryogenesis factor.

Cellular reprogramming responses were measured by observing callus induction, epi-fluorescent reporter gene expression levels, and somatic embryogenesis responses at day 14 in embryos treated with the experimental treatments relative to embryos treated with the experimental control treatments as shown in FIG. 1.

These result indicated that several of the embryogenesis factors, specifically dpzm02g056660.1.1 (embryogenesis factor 1; SEQ ID NO: 1 encoding SEQ ID NO: 17), dpzm03g050950.1.1 (embryogenesis factor 4; SEQ ID NO: 4 encoding SEQ ID NO: 20), dpzm07g031470.1.1 (embryogenesis factor 5; SEQ ID NO:5 encoding SEQ ID NO: 21), and dpzm09g039270.1.1 (embryogenesis factor 11; SEQ ID NO: 11 encoding SEQ ID NO: 27) each interacted with the morphogenic genes WUS2 and ODP2/BBM. For the remaining embryogenesis factors, each interacted with the morphogenic genes WUS2 or ODP2/BBM. However, it is expected that changing the regulatory elements for any of the expression cassettes used in these experiments would result in an altered response. Specifically it is expected that regulatory elements promoting higher gene activity would result in increased somatic embryogenesis responses and conversely it is expected that weaker regulatory elements would result in decreased somatic embryogenesis responses.

The embryogenesis factors listed in Table 6 were useful for activating embryogenic responses in plant cells and function as cellular reprogramming factors as evidenced by the generation of highly embryogenic calli in response to the experimental treatments. The results shown here demonstrated that co-expression of these embryogenesis factors with a morphogenic gene were useful for cellular reprogramming and the acquisition of an embryogenic cell fate. It is therefore expected these embryogenesis factors can be used to improve transformation efficiencies in maize.

For example, it is expected that a plasmid comprising; a first expression cassette i) containing a polynucleotide encoding the CRE/lox recombination system flanking a morphogenic gene/Embryogenesis Factor (EF)/CRE co-expression cassette, wherein CRE is operably linked to a desiccation-inducible RAB17 promoter allowing excision of morphogenic gene/EF/CRE co-expression cassette, and a second expression cassette ii) containing a polynucleotide encoding a gene of interest, for example UBI1ZM PRO+UBI1ZM 5UTR+UBI1ZM INTRON1+DS-RED2+PINII TERM (SEQ ID NO: 99), can be used to improve transformation efficiencies and regeneration of a transgenic plant transformed with the second expression cassette, such a transgenic plant expressing DS-RED2. It is understood that one or more morphogenic genes may be used in the morphogenic gene/EF/CRE co-expression cassette.

Example 5: Method for Modulating Cell Cycle Activity to Further Improve Somatic Embryogenesis Further improvements in cellular reprogramming and the acquisition of an embryogenic cell fate were obtained using delivery of an experimental treatment comprising a T-DNA containing (a) a morphogenic developmental gene operably linked to weak, constitutive promoter, (b) an embryogenesis factor operably linked to strong, tissue-preferred promoter, and (c) a cyclin dependent kinase operably linked to a strong, tissue-preferred promoter. This experimental treatment showed improved somatic embryogenesis in comparison to an experimental control treatment comprising a T-DNA containing (a) the same morphogenic developmental gene operably linked to weak, constitutive promoter and (b) the same embryogenesis factor operably linked to strong, tissue-preferred promoter.

A series of plasmids were constructed and used for delivery of a T-DNA containing either (a) the WUS2 or ODP2 morphogenic developmental gene operably linked to weak, constitutive promoter, (b) the embryogenesis factor, dpzm07g031470.1.1, herein also referred to as "DZ470" that is annotated as a cyclin delta-2 protein (embryogenesis factor 5, SEQ ID NO: 5 encoding SEQ ID NO: 21) operably linked to strong, tissue-preferred promoter, and either (c) the cyclin dependent kinase encoded by a gene dpzm01g001860.1.1 or dpzm04g074910.1.2, herein referred to as CDKA1 or CDKA3, respectively, operably linked to strong, tissue-preferred promoter (see Table 7).

TABLE 7

Plasmids for modulating cell cycle activity

| SEQ ID NO: | Plasmid | Features |
|---|---|---|
| 37 | RV010564 (WUS alone) | RB-NOSPRO::WUS:PINII TERM-UBI1ZMPRO::ZSYELLOW:PINII TERM-UBI1ZMPRO::PMI:PINII TERM-OSACTINPRO::MOPAT:CAMV35S TERM-LB |
| 38 | WUS + DZ470 | RB-ZMPLTP::DZ470:OST28 TERM-NO SPRO::WUS:PINII TERM-UBI1ZMPRO::DSRED:PINII TERM-UBI1ZMPRO::PMI:PINII TERM-OSACTINPRO::MOPAT:CAMV35S TERM-LB |
| 39 | WUS + DZ470 + CDKA1 | RB-ZMPLTP::DZ470:OST28 TERM-ZMPLTP::CDKA1:OST28 TERM-NO SPRO::WUS:PINII TERM-UBI1ZMPRO::DSRED:PINII TERM-UBI1ZMPRO::PMI:PINII TERM-OSACTINPRO::MOPAT:CAMV35S TERM-LB |
| 40 | WUS + DZ470 + CDKA3 | RB-ZMPLTP::DZ470:OST28 TERM-ZMPLTP::CDKA3:OST28 TERM-NO SPRO::WUS:PINII TERM-UBI1ZMPRO::DSRED:PINII TERM-UBI1ZMPRO::PMI:PINII TERM-OSACTINPRO::MOPAT:CAMV35S TERM-LB |
| 41 | BBM alone | RB-UBI1ZMPRO::ODP2:PINII TERM-UBI1ZMPRO::ZSYELLOW:PINII TERM-UBI1ZMPRO::PMI:PINII TERM-OSACTINPRO::MOPAT:CAMV35S TERM-LB |
| 42 | BBM + DZ470 | RB-ZMPLTP::DZ470:OST28 TERM-UBI1ZMPRO::ODP2:PINII TERM-UBI1ZMPRO::DSRED:PINII TERM-UBI1ZMPRO::PMI:PINII TERM-OSACTINPRO::MOPAT:CAMV35S TERM-LB |
| 43 | BBM + DZ470 + CDKA1 | RB-ZMPLTP::DZ470:OST28 TERM-ZMPLTPPRO::CDKA1:PST28 TERM-UBI1ZMPRO::ODP2:PINII TERM-UBI1ZMPRO::DSRED:PINII TERM-UBI1ZMPRO::PMI:PINII TERM-OSACTINPRO::MOPAT:CAMV35S TERM-LB |
| 44 | BBM + DZ470 + CDKA3 | RB-ZMPLTP::DZ470:OST28 TERM-ZMPLTPPRO::CDKA3:PST28 TERM-UBI1ZMPRO::ODP2:PINII TERM-UBI1ZMPRO::DSRED:PINII TERM-UBI1ZMPRO::PMI:PINII TERM-OSACTINPRO::MOPAT:CAMV35S TERM-LB |
| 45 | WUS + BBM | RB-UBI1ZMPRO::ODP2:PINII TERM-NOSPRO::WUS:PINII TERM-UBI1ZMPRO::ZSGREEN:PINII TERM-UBI1ZMPRO::PMI:PINII TERM-OSACTINPRO::MOPAT:CAMV35S TERM-LB |

Experiments testing for the activation of cellular reprogramming and somatic embryogenesis in response to the experimental treatments compared to the experimental control treatments were performed as described above. The efficacy of each vector to provide cellular reprogramming and the acquisition of an embryogenic cell fate was compared to the experimental control treatments with one of the two morphogenic developmental genes, for example SEQ ID NO:37 (WUS alone) or SEQ ID NO:41 (BBM alone), and the positive control treatment using both morphogenic developmental genes, for example SEQ ID NO:45 (WUS+BBM).

These results demonstrated that the level of somatic embryogenesis conferred by the embryogenesis factor "DZ470" (dpzm07g031470.1.1; polynucleotide SEQ ID NO: 5, encoding polypeptide SEQ ID NO: 21) was further improved when co-expressed with a developmental gene (WUS) (FIG. 2A) or a developmental gene (BBM) (FIG. 2B) and a cyclin dependent kinase (CDKA1 or CDKA3) (SEQ ID NO: 114 and SEQ ID NO: 115, respectively).

Figure 2A:
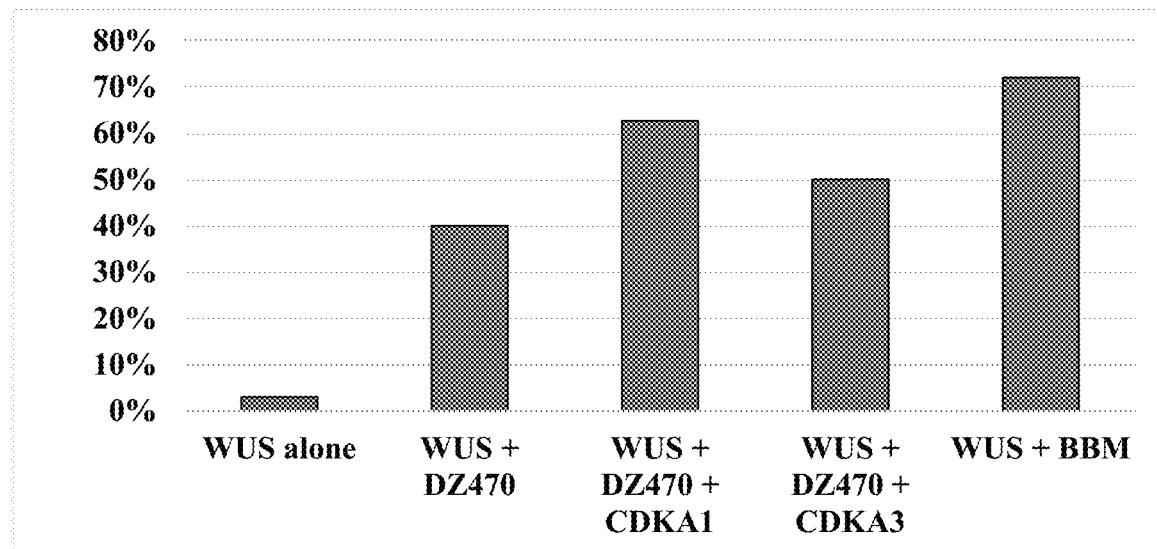
FIG. 2A shows the efficacy of somatic embryogenesis (% responsive; y axis) of immature maize embryos in response to plasmids co-expressing the DZ470 cyclin gene and a cyclin-dependent kinase gene (CDKA1 or CDKA3) in combination with a WUSCHEL gene.
Figure 2B:
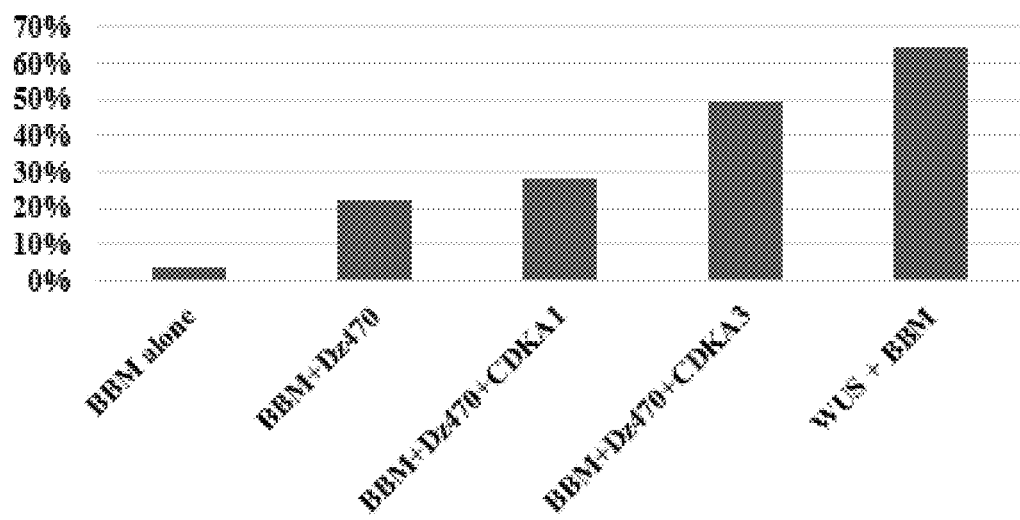
FIG. 2B shows the efficacy of somatic embryogenesis (% responsive; y axis) of immature maize embryos in response to plasmids co-expressing the DZ470 cyclin gene and a cyclin-dependent kinase gene (CDKA1 or CDKA3) in combination with an ODP2/BBM gene.

As shown in FIG. 2A, CDKA1 was more effective in transitioning cells to become more embryogenic in combination with the WUS morphogenic gene, while CDKA3 as shown in FIG. 2B was more effective in transitioning cells to become more embryogenic in combination with the ODP2 (BBM) morphogenic gene.

Example 6: Paternal Doubled Haploid Method Using Exogenous Proteins as Cellular Reprogramming Agents The following experiments demonstrate improving microspore embryogenesis by contacting a wild type microspore with an exogenous polypeptide that functions as a cellular reprogramming agent.

For example, a wild type microspore is contacted with an exogenous polypeptide that functions as a cellular reprogramming agent before, during, or after in vitro tissue culture. Specifically, the embryogenesis factors comprising SEQ ID NO: 1 through SEQ ID NO: 16 are used to generate a polypeptide comprising SEQ ID NO: 17 through SEQ ID NO: 32, respectively. The polypeptides of SEQ ID NO: 17 through SEQ ID NO: 32 are then contacted with microspores before, during, or after in vitro tissue culture. It is expected that contacting the polypeptides of SEQ ID NO: 17 through SEQ ID NO:32 with microspores will facilitate cellular reprogramming of the treated microspores resulting in embryogenic microspores.

It is expected that modifications to the polypeptides of SEQ ID NO: 17 through SEQ ID NO: 32 will further enhance microspore cellular reprogramming resulting in enhanced microspore embryogenesis. It is expected that translational fusion peptides of SEQ ID NO: 17 through SEQ ID NO: 32 wherein the peptides are fused at the N- or C-terminus of the peptide to a polyhistidine motif (histag) such as those of SEQ ID NO: 46 encoding SEQ ID NO: 47 will further increase microspore cellular reprogramming. In addition, it is expected that microspore cellular reprogramming will be further enhanced by treating isolated microspores with the histag translational fusion peptides of SEQ ID NO: 17 through SEQ ID NO: 32 that have been further modified by adding a cell penetrating peptide (CPP) at the N- or C-terminus of the polypeptide resulting in a embryogenesis factor-histag-cell penetrating translational fusion peptide having properties including but not limited to (a) cellular reprogramming activity, (b) a His-Tag acting as a metal binding site for a recombinant protein, and/or (c) a cell penetrating peptide facilitating improved cellular delivery thereby improving translocating the translational fusion peptide into an isolated maize microspore, resulting in improved cellular reprogramming and/or microspore embryogenesis.

Cell penetrating peptides (CCP) useful in the methods of present disclosure include but are not limited to the Z. mays knotted1 CPP (ZM-KNT1 CPP; SEQ ID NO: 48 encoding SEQ ID NO: 49), the Saccharomyces pombe TP10 CPP (SP-TP10 CPP; SEQ ID NO:50 encoding SEQ ID NO: 51), the Candida albicans Zebra CPP (CA-Zebra CPP; SEQ ID NO: 52 encoding SEQ ID NO: 53), the PEP1 CPP (PEP1 CPP; SEQ ID NO: 54 encoding SEQ ID NO: 55), the HIV-1 TAT CPP (HIV-1 TAT CPP; SEQ ID NO: 56 encoding SEQ ID NO: 57), and the gamma-zein cell penetrating peptide (GZ CPP; SEQ ID NO: 58 encoding SEQ ID NO: 59) (see U.S. Pat. No. 8,581,036, incorporated herein by reference in its entirety). It is expected that the delivery of such histag-CPP peptides into a plant cell, such as an isolated microspore will improve cellular reprogramming and thereby improve the regeneration of a non-transgenic plant.

Figure 3:
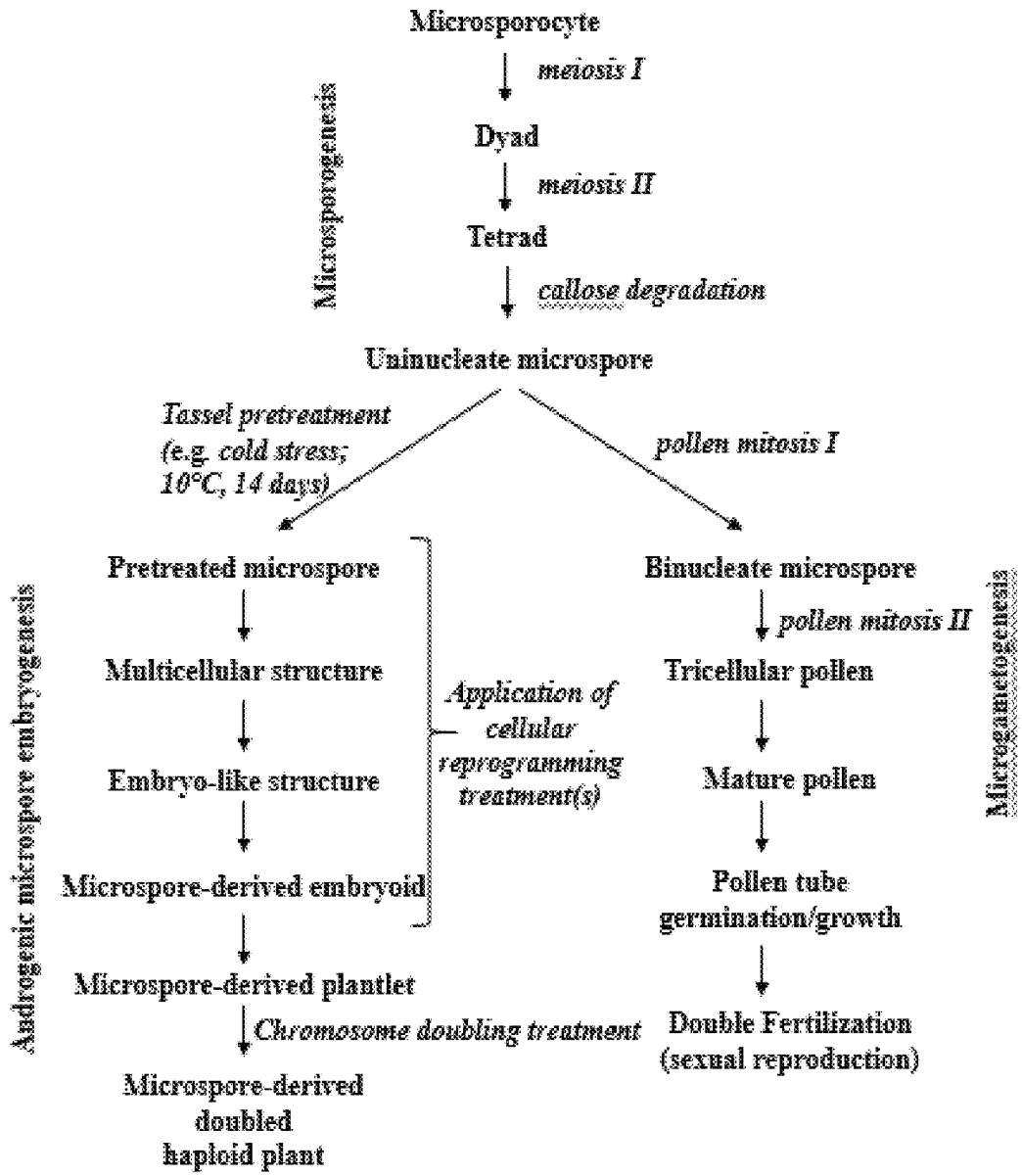
FIG. 3 is a schematic of improved microspore embryogenesis using cellular reprogramming treatments that activate androgenic microspore embryogenesis. Microsporogenesis steps are shown that result in the development of a microspore. The methods of the present disclosure describe methods for providing a cellular reprogramming agent to a plant cell whereby cell fate is altered, for example first by applying a cold stress pretreatment to the tassel, wherein the cell fate is no longer competent for microgametogenesis development, and secondly by application of a cellular reprogramming treatment. The cellular reprogramming treatment results in improved androgenic microspore embryogenesis responses characterized by cellular proliferation to a multicellular structure, then an embryo-like structure, then a microspore-derived embryoid, and then a microspore-derived plant upon germination and regeneration of the embryoid. The methods of the present disclosure may use a chromosome doubling treatment, for example a chromosome doubling treatment may be applied to a microspore derived plantlet, to obtain a microspore-derived doubled haploid plant.

As shown in FIG. 3, uninucleate microspores extracted from maize anthers will without further treatment transition into pollen mitosis I which is characteristic of microgametogenesis and develop into a mature pollen grain. The methods of present disclosure induce cellular reprogramming by treating an isolated microspore with the translational fusion peptides comprising an embryogenesis factor-histag-CPP.

It is expected that cellular reprogramming of microspores can be further enhanced by treating the microspores with the translational fusion peptides comprising an embryogenesis factor-histag-CPP combined with a morphogenic polypeptide. In particular, the translational fusion peptides comprising an embryogenesis factor-histag-CPP can be combined with a morphogenic polypeptide selected from the group consisting of (i) a functional WUS/WOX polypeptide (for example, polypeptide SEQ ID NO: 322); (ii) a Babyboom (BBM) polypeptide or an Ovule Development Protein 2 (ODP2) polypeptide (for example, polypeptide SEQ ID NO: 335); (iii) a LEC1 polypeptide (iv) a combination of (i) and (ii); and (v) a combination of (i) and (iii).

It is expected that further enhancements in microspore embryogenesis can be achieved by preparing translational fusion peptides comprising a morphogenic polypeptide-histag-CPP as described above for the embryogenesis factors and then treating microspores with a combination of the translational fusion peptides comprising an embryogenesis factor-histag-CPP and the translational fusion peptides comprising a morphogenic polypeptide-histag-CPP thereby resulting in improved microspore cellular reprogramming.

Translational fusion peptides of morphogenic developmental genes useful in the methods of the disclosure include but are not limited to BBM$^{404}$-FLAG-KNOTTED-1 CPP, comprising a 6XHis tag fused to a truncated ODP2/BBM peptide fused to a FLAG epitope fused to a KNOTTED-1 cell penetrating peptide (polynucleotide sequence SEQ ID NO: 122 encoding polypeptide sequence SEQ ID NO: 123) and WUS-HISTAG-GZCPP, comprising a 6XHis tag fused to a WUSCHEL peptide fused to a gamma-zein cell penetrating peptide (CPP) (polynucleotide sequence SEQ ID NO: 361 encoding polypeptide sequence SEQ ID NO: 362).

It is expected that further enhancements in microspore embryogenesis can be achieved by treating microspores with a combination of the translational fusion peptides comprising an embryogenesis factor-histag-CPP and/or the translational fusion peptides comprising a morphogenic polypeptide-histag-CPP and/or any of the translational fusion peptides disclosed above thereby resulting in improved microspore cellular reprogramming.

To obtain the translational fusion peptides described above for an embryogenesis factor (embryogenesis factor-histag-CPP) and/or a morphogenic polypeptide (morphogenic polypeptide-histag-CPP) a DNA plasmid is constructed with expression cassettes encoding each such translational fusion polypeptide. The DNA plasmid can be a protein expression vector constructed by transferring a DNA polynucleotide encoding each of such translational fusion polypeptides into a self-replicating gene element such as an expression vector, for example the pDAB135006 vector (SEQ ID NO: 60). The pDAB135006 vector (SEQ ID NO: 60) has the following features (a) the T7 promoter and the tobacco mosaic virus 5' leader sequence (omega), (b), a NcoI and KpnI cloning site for transferring a polynucleotide encoding a translational fusion polypeptide, (c) a 3'UTR, (d) a F1 origin of replication (F1 ori), and (d) blasticidin S-resistance gene (bla).

Translational fusion polypeptides are expressed using such a protein expression vector and the expressed recombinant proteins are used for the exogenous application of cellular reprogramming treatments as shown in FIG. 3. The methods of the present disclosure comprise using an in vitro translation system derived from Nicotiana tabacum L. cv. Bright Yellow 2 (BY-2) tobacco cells. Briefly, lysate from evacuolated BY-2 protoplasts is prepared, including the removal of nuclei and non-disrupted cells, and the lysate is frozen at −80° C. in 1 mL aliquots, thereby allowing coupling of both transcription and translation from the protein expression vector.

Methods for harvesting tassels, including sterilization methods and tassel pretreatments, for example, temperature pretreatments, will vary depending on the intended tassel use. Prior to selecting tassels for microspore culture, microspores must be staged to an appropriate stage, typically between the uninucleate to binucleate stage. Typically, for tassels with microspores at the appropriate stage, the tassels are detached, and each tassel is individually wrapped in aluminum foil. Isolation of microspores typically occurs after a tassel pretreatment in a reduced temperature environment to improve the androgenic response. A commonly used technique is to place foil wrapped tassels at 10° C. for between 1 to 21 days. Additionally, anthers can be precultured in a mannitol solution, for example 0.3 M liquid mannitol plus 50 mg/L ascorbic acid.

Prior to use, tassels are surface-sterilized in a 30% Clorox (8.25% Sodium Hypochlorite diluted v/v) solution plus two drops of Tween 80 for approximately fifteen minutes, with gentle agitation on a reciprocal shaker. The tassels are then rinsed three or more times in sterile water at room temperature and placed in a large petri dish and typically left uncovered for 1-1.5 hours under aseptic conditions to allow any excess water to evaporate prior to microspore isolation. Alternatively, florets are detached from the tassel and placed in permeable baskets that are then submerged in a 30% Clorox (8.25% Sodium Hypochlorite diluted v/v) solution plus two drops of Tween 80 for fifteen minutes followed by rinsing as described above. The spikelets are placed in a large petri dish and typically left uncovered for 1-1.5 hours to allow excess water to evaporate prior to microspore isolation.

Microspores can be isolated from maize anthers and florets by numerous methods including, but not limited to, glass rod maceration methods, blending methods, razor blade tissue cutting methods, tissue homogenizer methods, and tissue grinder methods.

Following isolation of microspores from the surrounding somatic tissue, the microspores are typically purified immediately after separation from any anther debris and placed into a fresh isolation medium. A common method of separating microspores from anther debris is to pass a blended microspore anther debris slurry from the isolation procedure through a sieve. Alternatively, the microspore anther debris slurry is passed through several layers of cheesecloth or a mesh filter. Further separation can be performed using a discontinuous density centrifugation method or additional filtration methods, including but not limited to, methods using a sucrose or Percoll gradient. In methods using a Percoll gradient, the cells captured at the 20-30% interface which range from 20-50% of the cells after centrifugation at 225 g for 3 min can be further separated using a final, high sucrose (0.44M) centrifugation method Any of the separation methods described above can be optimized as needed.

Media used during microspore isolation typically consists of 6% sucrose, 50 mg/L acorbic acid, 400 mg/L proline, 0.05 mg/L biotin and 10 mg/L nicotinic acid. Other media and solutions used for the culturing of maize microspores are like those used for other cereal tissue culture procedures and various media modifications can be used Common features for maize culture media typically include the use of Chu's N6 basal medium with vitamins (N6), NLN basal medium (NLN), or YP basal media (YP) formulations with relatively high sugar concentrations (6-12%) and may have constituents including triiodobenzoic acid, various phytohormones, and/or proline.

It is expected that treating microspores with the cellular reprogramming treatments disclosed in this Example 6 either alone and/or in the combinations disclosed in this Example 6 and/or in combination with the cellular reprogramming treatments disclosed in Example 5 will improve cellular reprogramming. It is expected that these treatments and combinations of treatments with illicit a parthenogenic response, as shown in FIG. 3, within the microspore and will change the cell fate of the microspore from microgamatogenesis to an androgenic microspore embryogenesis response. It is also expected that using multiple embryogenesis factors selected from the polypeptides of SEQ ID NO: 17 through SEQ ID NO: 32 combination with the cellular reprogramming treatments disclosed in this example 6 will further improve microspore cellular reprograming.

After any of the cellular reprogramming treatments disclosed above, as shown in FIG. 3, a microspore-derived haploid plantlet can be transferred to resting medium with a chromosome doubling (or mitotic inhibitor) agent to create a doubled haploid plant. For example, the plantlet is treated with colchicine at concentrations of 0.1-1.0 g/ml for a 24-hour period to cause mitotic arrest of dividing cells at metaphase by interfering with microtubule organization before transfer to a resting medium without a chromosome doubling agent followed by incubation at 28° C. under dark conditions and then transferring to maturation medium without selection. Alternatively based on the morphological development of a microspore-derived embryo, or embryoid, resulting from the treated microspore, the microspore-derived embryoid is treated with a chromosome doubling agent for a 24-hour period before transfer to a resting medium without a chromosome doubling agent followed by incubation at 28° C. under dark conditions and then transferring to maturation medium without selection.

Example 7: Paternal Doubled Haploid Method for dCas9 Technologies as Cellular Reprogramming Agents The cellular reprogramming methods of the present disclosure comprise treating a cell having a target locus with a heterologous protein, including a heterologous protein complexed with a guide RNA that hybridizes with the target locus and alters gene regulation at the target locus resulting in cellular reprogramming of the cell. Target loci useful in the cellular reprogramming methods of the present disclosure include those loci encoding the embryogenesis factors listed in Table 6 and/or loci encoding morphogenic developmental genes including but not limited to ODP2/BBM, WUS, or LEC1 morphogenic genes and combinations thereof.

It is expected that cell fate reprogramming can be achieved using a dCas9 translational fusion protein/gRNA complex recruited to a region of a target locus. For example, it is expected that a cell from a plant tissue, such as a leaf cell, wherein the gene at the target locus is not expressed, can be transcriptionally activated after being treated with the dCas9 translational fusion protein/gRNA complex specific for that gene at the target locus.

It is expected, using the cellular reprogramming methods of the present disclosure, that altering the gene regulatory state of an endogenous locus in a gametic cell, such as a uninucleate microspore or an egg cell, will result in gene activation and reprogramming of the cell thereby conferring on the treated cell an improved embryogenic phenotype. The cellular reprogramming methods of the present disclosure use RNA-guided CRISPR-Cas9 systems to hybridize to DNA encoding a target locus or sequence, whereby expression of the at least one gene product is altered. Target loci or sequences of interest include but are not limited to embryogenesis factors listed in Table 6 and morphogenic developmental genes. The RNA-guided CRISPR-Cas9 systems useful in the cellular reprogramming methods of the disclosure include designs for heterologous proteins comprising a degenerate, also known as a deactivated, Cas9 protein (dCas9) used as a recognition domain that is fused to a regulatory domain, such as a transcriptional activator domain, transcriptional repressor domain, and/or a chromatin modification domain useful for altering expression at the target locus or sequence.

Recruitment of a dCas9-fusion protein to the endogenous locus encoding each of the embryogenesis factors listed in Table 6 and/or a morphogenic developmental gene is achieved using guide RNAs (gRNAs). Once the ribonucleotide complex is recruited to the target locus, cellular reprogramming is achieved by altering expression of at least one gene product, including but not limited to post-translational modifications of histone modifications, including but not limited to (a) removing histone modifications associated with repressing gene expression, (b) establishing histone modifications associated with promoting gene expression, and/or (c) recruiting transcriptional machinery associated with expressing a gene, and combinations of (a), (b), and/or (c). This altered expression of at least one gene product reprograms a treated microspore from a microspore cell fate to an embryogenic cell fate thereby improving maize paternal doubled haploid production.

Heterologous proteins comprising dCas9 translational fusion proteins containing chromatin modification domains, including a histone demethylase domain, particularly the Jumanji family of lysine demethylases conferring histone demethylase catalytic activity, herein referred to as a dCAS9-jmj fusion protein are useful in the cellular reprogramming methods of the present disclosure. Heterologous proteins comprising a deactivated Cas9 (dCas9) protein fused to the histone acetyltransferase (HAT) domain, including but not limited to HAT domains characterized as a General Control Nonrepressed (Gcn5)-related N-acetyltransferases (GNAT) domain, a MYST domain, and/or a type B catalytic subunit domain, with each known to confer histone acetyltransferase catalytic activity, herein referred to as a dCas9-HAT fusion protein are also useful in the cellular reprogramming methods of the present disclosure. These dCas9 translational fusion proteins are used as cellular reprogramming agents in the methods of the present disclosure. Chromatin modifying domains are shown in Table 8. dCas9 translational fusion expression cassettes containing the chromatin modification domains of Table 8 are shown in Table 9.

TABLE 8

Regulatory domains useful for dCas translational fusion proteins

| Domain Name | Domain Feature | DNA SEQ ID NO: | Peptide SEQ ID NO: |
|---|---|---|---|
| GNAT1 | General Control Non-repressed (Gcn5)-related N-acetyltransferases (GNAT) domain 1 | 61 | 67 |
| GNAT2 | General Control Non-repressed (Gcn5)-related N-acetyltransferases (GNAT) domain 2 | 62 | 68 |
| HAT1 | MOZ, Ybf2/Sas3, Sas2 and Tip60 proteins (MYST) domain | 63 | 69 |
| HAT2 | type B catalytic subunit (HAG2) domain | 64 | 70 |
| ZM-JMJN | Jumonji N domain-containing histone demethylase domain | 65 | 71 |
| ZM-JMJC | Jumonji C domain-containing histone demethylase domain | 66 | 72 | ponent of Arabidopsis CBF1 protein in an expression cassette operably linked to the Zea mays UBIQUITIN promoter and using a PIN II terminator sequence (referred to as dCas9-CBF1A, polynucleotide SEQ ID NO: 85 encoding polypeptide SEQ ID NO: 86). Alternatively, a transcriptional activator domain of the VP64 domain (polynucleotide SEQ ID NO: 244 encoding polypeptide SEQ ID NO: 245) is another option for a regulatory domain that can be fused to a dCas9 for use in the cellular reprogramming methods of the present disclosure.

For the methods described in this Example 7, guide RNA molecule delivery can be performed using an RNA molecule that is a non-natural fusion of two RNA molecules, a crRNA (CRISPR RNA) comprising a variable targeting domain (linked to a tracr mate sequence that hybridizes to a tracrRNA), fused to a tracrRNA (trans-activating CRISPR RNA). The guide RNA (gRNA) can comprise a crRNA or crRNA fragment and a tracrRNA or tracrRNA fragment of the type II CRISPR/Cas system that can form a complex with a type II deactivated Cas endonucleases wherein the gRNA/dCas9 endonuclease complex can be directed to a DNA target site enabling the dCas9 endonuclease to recognize and bind to the DNA target site, thereby allowing the functional activity conferred by the heterologous dCas9 endonuclease fusion protein(s) described above to alter gene regulation of the target locus.

Methods for providing a gRNA to a cell include but are not limited to introducing a single stranded or double stranded polynucleotide molecule to the cell, for example as gRNA molecules generated using a DNA plasmid-expressed

TABLE 9 dCas9 translational fusion expresson cassettes useful as cellular reprogramming factors

| Fusion Name | Features elements | DNA SEQ ID NO: | Peptide SEQ ID NO: |
|---|---|---|---|
| dCas9-GNAT1 | UBI1ZM PRO::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-GNAT1-V1::PINII TERM | 73 | 78 |
| dCas9-GNAT2 | UBI1ZM PRO::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-GNAT2 (TR1)::PINII TERM | 74 | 79 |
| dCas9-HAT1 | UBI1ZM PRO::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-HAT1 (TR1)::PINII TERM | 75 | 80 |
| dCas9-HAT2 | UBI1ZM PRO::UBI1ZM 5UTR::UBI1ZM::SV40 NLS::CAS9 EXON1 (SP)(MO)::ST-LS1 INTRON2::CAS9 EXON2 (SP) (MO)::VIRD2 NLS (TR2)::30XQ-V2::ZM-HAT2 (TR1)::PINII TERM | 76 | 81 |
| dCAS9-jmj | UBI1ZM PRO::UBI1ZM 5UTR::UBI1ZM INTRON1::SV40 NLS::ZM-JMJN::GLY4SER LINKER::ZM-JMJN::GLY4SER LINKER::CAS9 EXON1 (SP) (MO) (MOD1) (TR1)::ST-LS1 INTRON2::CAS9 EXON2 (SP) (MO) (ALT1)::GLY4SER LINKER::ZM-JMJC (TR1)::VIRD2NLS::PINII TERM | 77 | 82 |

A deactivated Cas9 (dCas9) protein fused to a transcriptional activator domain is also useful in the cellular reprogramming methods of the present disclosure. One such domain useful in the cellular reprogramming methods of the present disclosure is from the Arabidopsis CBF1 protein. In particular, the D10A and H840A mutations in Spy Cas9 (polynucleotide SEQ ID NO: 83 encoding polypeptide SEQ ID NO: 84) was fused to the transcriptional activator comgRNA, or as an in vitro transcribed gRNA, or as synthetic (sgRNA) produced using solid-phase RNA synthesis chemistries.

For a guide RNA delivered into a cell by introducing a recombinant DNA molecule, the method comprises operably linking a heterologous nucleic acid fragment encoding the guide RNA (or crRNA+tracrRNA) to a specific promoter capable of transcribing the guide RNA (crRNA+tracrRNA molecules). Guide RNA molecules C5, C4, C3, C2, and C1 (SEQ ID NO: 87-91, respectively) targeting the promoter region of WUS2 can be operably linked to the *Zea mays* RNA polymerase III promoter (SEQ ID NO: 92) that allows transcription of RNA with precisely defined, unmodified, 5'- and 3'-ends. Alternatively, any promoter capable of transcribing the guide RNA in a cell can be used.

It is expected that using guide RNA molecules designed to simultaneously target multiple loci can further improve the cellular reprogramming of a cellular reprogramming agent. For example, methods using gRNA molecules capable of binding to a target site encoding an embryogenesis factor (polynucleotide SEQ ID NOS: 1 to 16), and a morphogenic developmental gene encoded in a plant genome can improve cellular reprogramming of a maize microspore, thereby resulting in improved paternal double haploid production methods.

It is furthermore understood that gRNA molecules capable of binding to a locus encoding an embryogenesis factor and/or to a locus encoding a morphogenic developmental gene shall include a region flanking the locus encoding the embryogenesis factor and/or a region flanking the locus encoding the morphogenic developmental gene, including proximal regulatory regions up to 10,000 nucleotides upstream or downstream of the locus. Additionally, gRNA molecules capable of binding to cis regulatory regions of a target locus are also useful in the cellular reprogramming methods of the present disclosure.

Given the genetic diversity of different *Zea mays* cultivars, or inbreds, it is expected that different inbreds will have different alleles at a target locus, wherein the different alleles have DNA sequence variation at the locus. Therefore, it is understood that allele-specific gRNA sequence compositions will compliment corresponding DNA allele sequences, thereby conferring optimal hybridization at the target locus.

Multiplexed genetic targeting agents are useful in the cellular reprogramming methods of the present disclosure. One such multiplexed genetic targeting agent is Cas6, previously known as Csy4. Cas6 can cleave within a precursor RNA molecule, called a pre-crRNA, containing repeat sequences generating mature guide RNAs. The mature single guide RNA (gRNA), comprising a crRNA and a tracrRNA can associate with a dCas9 protein forming a programmable source of gRNA-Cas9 ribonucleotide protein complex (RNPs) allowing recruitment of RNPs to multiple targets in a cell. The multiple targets in a cell of interest for cellular reprogramming of a treated microspore from a microspore cell fate to an embryogenic cell fate as disclosed herein include but are not limited to target loci encoding an embryogenesis factor loci and/or target loci encoding a morphogenic developmental gene loci.

The cellular reprogramming methods of this Example 7 include treating a cell with a heterologous protein cellular reprogramming agent, including a heterologous protein complexed with a guide RNA. The heterologous protein cellular reprogramming agent alters gene regulation in a cell at an endogenous locus encoding a target site. More specifically, the heterologous protein cellular reprogramming agent is a dCas9 translational fusion protein complexed with a gRNA introduced into a cell, for example an isolated, wild type microspore wherein the treated microspore is reprogramed from a microspore cell fate to an embryogenic cell fate to obtain a microspore-derived haploid plant.

A. Cellular Reprogramming Method Using DNA Plasmid Particle Bombardment.

In this Example 7, degenerate Cas9-mediated cellular reprogramming agents were delivered into isolated maize microspores using particle bombardment. It is understood that a different method can be used to deliver the degenerate Cas9-mediated cellular reprogramming agents into isolated maize microspores. It is also understood that a similar protocols may be used for the treating microspores of other plants, including, but not limited to: soybean, cotton, canola, wheat, rice, sorghum, or sunflower. A single plasmid or multiple plasmids may be used for each particle bombardment. For example, a plurality of plasmids including: 1) a plasmid comprising an expression cassette for the degenerate Cas9-chromatin remodeling fusion protein, and 2) a plasmid comprising an expression cassette for the gRNA, or gRNAs, and optionally 3) a plasmid comprising a reporter gene cassette can be co-bombarded.

To test the functional activity of dCAS9-chromatin modifying translational fusion proteins, different combinations of guide RNAs were delivered into isolated microspores and were monitored for an androgenic microspore embryogenesis response resulting from improved cellular reprogramming.

DNA plasmids containing single gRNA expression cassettes (SEQ ID NOS: 201-206, see Table 4) corresponding to gRNA molecules C5, C4, C3, C2, and C1 (SEQ ID NOS: 87-91, respectively) operably linked to a pol III promoter (SEQ ID NO: 92) targeting endogenous WUS2 were co-bombarded with a DNA plasmid containing the aforementioned dCas9 translational fusion proteins, for example the dCas9-CBF1A expression cassette.

Optionally, DNA plasmids containing a multiplexed genetic targeting agent can be used, for example a DNA plasmid (SEQ ID NO: 206) containing expression cassettes comprising polynucleotides encoding, 1) a maize optimized Cas6/Csy4 peptide, 2) a precursor RNA molecule capable of targeting the maize endogenous ODP2/BBM locus, and optionally 3) a ZsYELLOW color marker protein.

The DNAs used in this Example 7 were attached to gold particles using standard methods. Particle bombardment was performed using a PDS-1000/He system (Bio-Rad, #166-2257) under vacuum at −28 inches of Mercury (in.Hg) with a helium pressure of 650 psi and a 6 cm target distance.

Optionally, methods to improve transient expression can be performed to provide increased transcription and expression, while precluding subsequent release of the DNA. One such method condenses DNA plasmids of interest using polyethylenimine (PEI; Sigma #P3143). PEI condenses DNA into a positively charged polymer-DNA complex, called a polyplex. After entering a cell, increased transcriptional activity of a polyplex results from the ability of the polymer-DNA complex to avoid acidic lysosomes. Specifically, the buffering capacity of PEI leads to osmotic swelling and rupture of lysosomes, thus allowing for improved DNA transcription in the cytoplasm. Gold particles are coated with PEI prior to adding the DNAs.

Prior to bombardment, isolated microspores were placed on a tissue culture plate or, optionally, the cells can be placed on a sterile polycarbonate membrane (Millipore Sigma, #ATTPO2500), thereby allowing for transfer after bombardment. Bombarded cells were incubated under dark conditions at 28° C. After 14-28 days, multicellular structures (MCS) were transferred to solidified 289Q culture medium and incubated under dark conditions at 28° C. until plantlet germination.

Particle bombardment using transient expression DNA plasmids was performed as described above using DNA plasmids comprising expression cassettes encoding a dCas9-CBF1A fusion protein (SEQ ID NO: 85) and gRNA molecules PHP89615 (SEQ ID NO: 201), PHP89613 (SEQ ID NO: 203), PHP89611 (SEQ ID NO: 205), and RV038531 (SEQ ID NO: 206) targeting WUS2 and BBM/ODP2 genomic loci.

Bombardment of freshly isolated corn microspores with these cellular reprogramming agents improved initiation of an embryogenic response which was characterized by increased cell proliferation and sporopollenin rupture of the exine in a subset of responsive microspores. Further embryogenic response progression was characterized by the transition of a multicellular structure (MCS) further developing into an embryo-like structure (ELS). The transition to an organized structure capable of germinating in vitro to give rise to a plantlet was not observed.

Isolated corn microspores were cultured for approximately 14 days to generate multicellular structures (MCS). Bombardment of these MCS with these cellular reprogramming agents also exhibited an improved initiation of an embryogenic response which was characterized by increased cell proliferation and sporopollenin rupture of the exine in a subset of responsive microspores. Further embryogenic response progression was characterized by the transition of a treated MCS further developing into an embryo-like structure (ELS) that then transitioned to an embryoid which is an organized structure capable of germinating in vitro to obtain a plantlet (FIG. 4B-FIG. 4E).

Figure 4A:
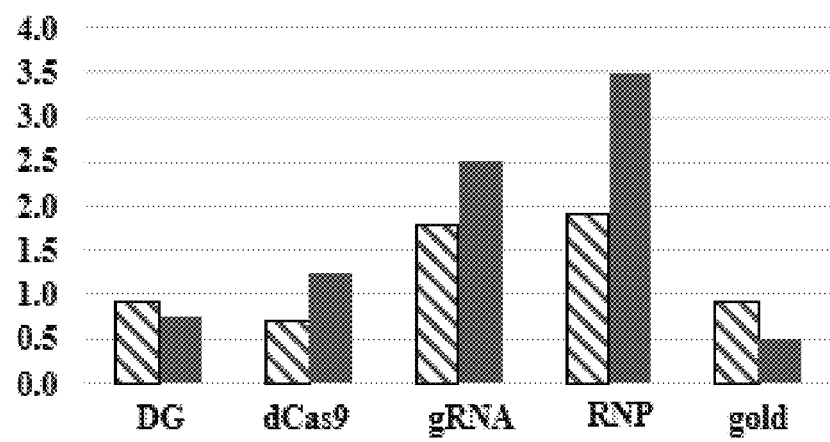
FIG. 4A-FIG. 4E shows the relative efficacy of various DNA particle bombardment treatments as compared to the non-treated control (NTC).

An embryogenic response, as shown in FIG. 4A, was demonstrated following these experimental treatments. The ratio of embryo-like structures (ELS) productivity for experimental treatments (DG, dCas9, gRNA, RNP, and gold) in comparison to a non-treated control (NTC) treatment showed a slight improvement in embryogenic response in some replicates when the cells were bombarded with an expression vector containing a polynucleotide encoding WUS2 and ODP2/BBM proteins (labeled DG, SEQ ID NO: 210) or an expression vector containing a polynucleotide encoding a dCas9-CBF1A polynucleotide (labeled dCas9, SEQ ID NO: 85), and when cells were bombarded with un-labelled gold particles (labeled gold). Overall these results for DG, dCas9, and gold indicated a relatively unchanged cellular reprogramming response. As shown in FIG. 4A, an embryogenic response was demonstrated following the gRNA and RNP experimental treatments.

As shown in FIG. 4A (labeled gRNA), improved cellular reprogramming was observed in response to bombardment using DNA vectors containing gRNA molecules targeting the WUS2 genomic site, namely bombardment with PHP89615 (SEQ ID NO: 201), PHP89613 (SEQ ID NO: 203), PHP89611 (SEQ ID NO: 205), and RV038531 (SEQ ID NO: 206). An embryogenic response was observed after bombarding freshly isolated corn microspores with DNA plasmids containing gRNA molecules PHP89615 (SEQ ID NO: 201), PHP89613 (SEQ ID NO: 203), and PHP89611 (SEQ ID NO: 205) targeting the WUS2 genomic locus. However, this developing embryo-like structure (ELS), that was over 0.9 mm in length (FIG. 4C), failed to sustain continued embryoid development over time.

Figure 4B:
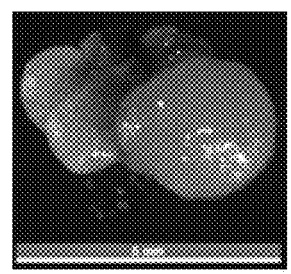
Figure 4C:
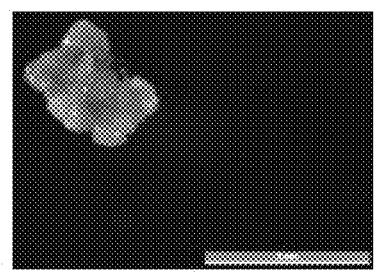
Figure 4D:
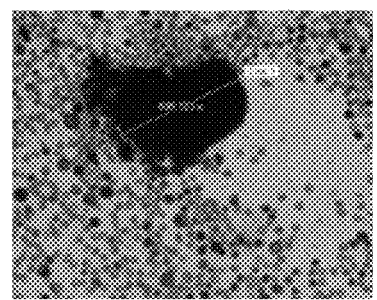
Figure 4E:
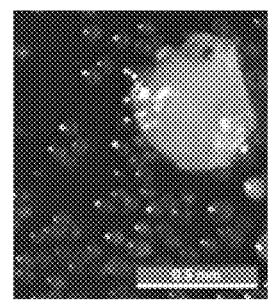
Figure 5A:
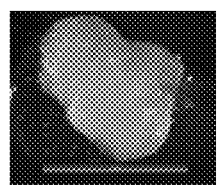
FIG. 5A-FIG. 5D shows embryoid development in response to dCas9-HAT1 RNP treatment targeting the WUS and BBM genomic sites. The cellular reprogramming response is shown for microspore-derived cells.
Figure 5B:
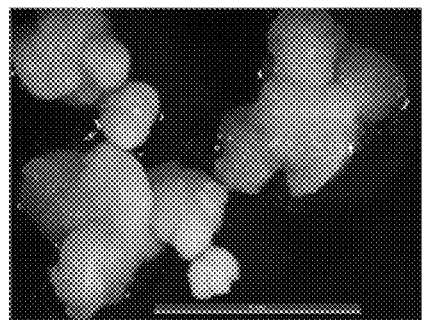
Figure 5C:
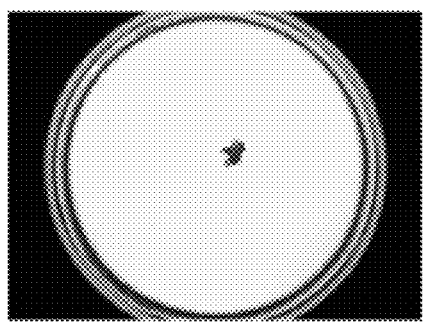
Figure 5D:
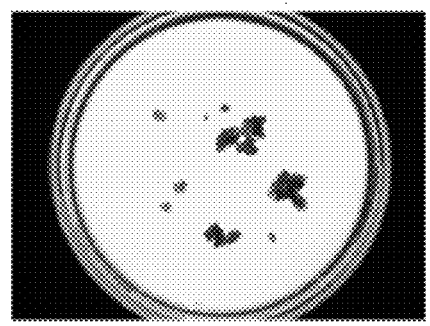

An improved microspore embryogenesis response was also observed after co-bombarding cells with expression vectors containing polynucleotides encoding a dCas9-CBF1A polynucleotide (SEQ ID NO: 85) and with the gRNA molecules targeting the WUS2 and BBM genomic sites, namely co-bombardment with PHP89615 (SEQ ID NO: 201), PHP89613 (SEQ ID NO: 203), PHP89611 (SEQ ID NO: 205), and RV038531 (SEQ ID NO: 206). As shown in FIG. 4A (labeled RNP) which is a transient expression treatment comprising a fully functional dCas9 ribonucleoprotein complex treatment designed to target the WUS2 and BBM/ODP2 genomic sites. The rate for embryoid development in response to the RNP treatment, as shown in FIG. 4B, was observed within 14 days of bombardment indicating an improved cellular reprogramming response.

When bombarding multicellular structures derived from corn microspores cultured for approximately 14 days, approximately a 2-fold increase in ELS productivity was observed in comparison to responses observed using freshly isolated corn microspores.

It is expected that delivery of a PEI-DNA complex into corn microspores cultured for approximately 14 days will result in improved microspore embryogenic responses.

Further experiments were conducted to evaluate the cellular reprogramming responses and to further characterize the microspore embryogenesis responses to bombardment using synthetic gRNA molecules, with and without a dCas9-CBF1A polynucleotide (SEQ ID NO: 85).

B. Cellular Reprogramming Method Using DNA Plasmid and sgRNA Particle Co-Bombardment.

sgRNA molecules were designed and synthesized for the target loci of WUS2, ODP2/BBM, and LEC1 (SEQ ID NOS: 207-209, respectively). Each of these sgRNA molecules were attached to gold particles and bombarded into cells as described above. An improved cellular reprogramming response was observed in microspores bombarded with the WUS2 and ODP2/BBM sgRNA molecules (FIG. 4D) relative to non-treated microspore cells. The the sgRNA were bombarded inot microspores alone without a transient expression vector containing a dCas9-CBF1A polynucleotide. These results show that contacting cells with sgRNA alone improved cellular reprogramming. These results show that RNA, including but not limited to RNA produced as a strand-specific transcript from a genetic response element acted as a key functional switch to promote cellular reprogramming in a plant cell by enabling a DNA response element to act as either an enhancer or repressor when using opposing strand RNA molecules.

C. Cellular Reprogramming Method Using Ribonucleotide Protein Complexes.

Particle bombardment is used to deliver RNP complexed cellular reprogramming agents to plant cells.

Degenerate Cas9 translational fusion proteins can be expressed using a protein expression system, for example as described above by transferring a polynucleotide sequence encoding a dCas9 protein fusion as described in Table 9 into a protein expression vector, for example the pDAB135006 vector (SEQ ID NO: 60). Standard protein expression methods can be performed to express and then purify the recombinant proteins, for example dCas9 fusion proteins in Table 9 (SEQ ID NOS: 78-82), optionally used in combination with a dCas9 transcriptional activator, for example a polypeptide expressed from a polynucleotide encoding SEQ ID NO: 84 fused to SEQ ID NO: 86. Other protein expression vectors and protein expression systems may be used.

A dCas9-CBF1a polypeptide was expressed from a protein expression cassette encoding SEQ ID NO: 84 and SEQ ID NO: 86 fused to a His-MBP-tag and purified using an *E. coli* expression system. First, an expression construct was transformed into either *E. coli* BL21(DE3) or ArcticExpress (DE3) strains and cultures were grown in LB broth supplemented with selective agent (e.g. ampicillin (100 μg/ml)). After culturing to an $OD_{600}$ of 0.5, the temperature was decreased to 16° C. and expression induced with IPTG (0.5 mM) or arabinose (0.2% (w/v)). After 16 h, cells were pelleted and re-suspended in loading buffer (20 Tris-HCl, pH 8.0 at 25° C., 1.5 M NaCl, 5 mM 2-mercaptoethanol, 10 mM imidazole, 2 mM PMSF, 5% (v/v) glycerol) and disrupted by sonication. Cell debris was removed by centrifugation. The supernatant was loaded on a $Ni^{2+}$-charged HiTrap chelating HP column (GE Healthcare) and eluted with a linear gradient of increasing imidazole concentration (from 10 to 500 mM) in 20 mM Tris-HCl, pH 8.0 at 25° C., 0.5 M NaCl, 5 mM 2-mercaptoethanol buffer. The fractions containing dCas9-CBF1a polypeptide were pooled and subsequently loaded on a HiTrap heparin HP column (GE Healthcare) for elution using a linear gradient of increasing NaCl concentration (from 0.1 to 1.5 M). The next fractions containing dCas9-CBF1a protein were pooled and the tag was cleaved by overnight incubation with TEV protease at 4° C. To remove cleaved His-MBP-tag and TEV protease, reaction mixtures were loaded onto a HiTrap heparin HP 5 column (GE Healthcare) for elution using a linear gradient of increasing NaCl concentration (from 0.1 to 1.5 M). Next, the elution from the HiTrap columns was loaded on a MBPTrap column (GE Healthcare) and dCas9-CBF1a polypeptide was collected as flow though. The collected fractions were then dialyzed against 20 mM Tris-HCl, pH 8.0 at 25° C., 500 mM NaCl, 2 mM DTT, and 50% (v/v) glycerol and stored at −20° C. until use.

Briefly, RNP assembly of the RNP complexed cellular reprogramming agents was performed by combining Riboguard RNase Inhibitor (1 µL; Lucigen #RG90925), 10× reaction buffer 3.1 (2.0 µL; New England Biolabs #B7200S), 1 µL of the dCas9-CBF1a fusion protein (5 µg protein/µL), gRNA molecules (1.5 µg/gRNA) for targeting genomic WUS2, ODP2/BBM, and LEC1 loci (SEQ ID NO: 207-209, respectively) and nuclease-free water (Thermo Fisher scientific #AM9932) to a 20 µL final volume in a RNase-free microfuge tube. The RNP assembly mixture was incubated at room temperature for approximately 15 minutes and then the tube was placed on ice. The pre-mixed RNP assembly was combined with sonicated gold particles (30 µL; 6 µg/µl) and gently mixed before incubating on ice for approximately 10 minutes.

Carrier disks were loaded by centrifuging the RNP complexed cellular reprogramming agents/gold suspension at 10,000 rpm for 60 seconds, removing the supernatant, and resuspending the pellet in 50 µl of RNase-free $H_2O$ by short sonication (~10 seconds) with pipetting to mix well, and dispensing 10 L volume per disk. Particle bombardment was then performed as previously described.

Additionally, the RNP complexed cellular reprogramming agents was prepared, filter sterilized, and incubated at room temperature for approximately 15 minutes and then added directly to maize microspore cells, freshly isolated microspores or microspores that had been cultured for 14-days filtered and washed using a 70 µm cell strainer (Fisher Scientific, #22-363-548). After contacting and incubating the cells with the RNP complexed cellular reprogramming agents, treated cells were transferred to a tissue culture plate for bombardment with unlabeled, sonicated gold particles as described above.

Improved microspore embryogenesis responses of microspore cells to cellular reprogramming using DNA plasmids described herein are shown in FIG. 4A-FIG. 4E. In view of those results, it is expected that providing RNP complexed cellular reprogramming agents to a microspore-derived cell will improve cellular reprogramming by altering the cell's initial cell fate to become an embryogenic cell fate to provide a microspore-derived embryoid. When this microspore-derived embryoid is treated with a chromosome doubling agent, it is expected that a maize paternal doubled haploid plant will be produced.

D. Cellular Reprogramming Method Using Combinatorial dCas9 Technologies as Cellular Reprogramming Agents The cellular reprograming effects of a combination of cellular reprogramming agents was evaluated. Cells were co-bombarded with a combination of plasmids comprising a dCas9 transcriptional activator and a dCas9 histone acetyltransferase fusion protein and the cellular reprogramming effects were evaluated. Co-bombardment of these cellular reprogramming agents altered post-translational modifications of chromatin at genomic target sites and simultaneously promoted transcriptional up-regulation at genomic target sites. Such combined activities conferring cellular reprogramming in a microspore-derived cell are expected to further improve an androgenic, microspore embryogenesis response, thereby improving paternal doubled haploid production in recalcitrant maize genotypes.

In accordance with the methods described above, the following plasmids were used: 1) a first DNA plasmid, the dCas9-CBF1A plasmid, having a polynucleotide encoding a dCas9-CBF1A translational fusion protein (polynucleotide SEQ ID NO: 85 encoding polypeptide SEQ ID NO:86) (a first transcriptional up-regulation treatment); 2) a second DNA plasmid, the dCas9-VP64 plasmid, having a polynucleotide encoding a dCas9-VP64 translational fusion protein (a dCas9 sequence (polynucleotide SEQ ID NO:83 encoding polypeptide SEQ ID NO:84) fused to the transcriptional activator component of the VP64 domain (polynucleotide SEQ ID NO:244 encoding polypeptide SEQ ID NO:245)) (a second transcriptional up-regulation treatment); and 3) a third DNA plasmid, the dCas9-HAT2 plasmid, having a polynucleotide encoding a dCas9 histone acetyltransferase 2 translational fusion protein (SEQ ID NO:76) (a chromatin modification treatment (enrich the target locus with increased levels of histone acetylation modifications correlated to active gene expression)).

The following treatments were used on a first bombardment carrier disk: 1) a first treatment that bombarded dCas9-CBF1A plasmid; 2) a second treatment that bombarded the dCas9-VP64 plasmid; 3) a third treatment that co-bombarded the dCas9-CBF1A plasmid and the dCas9-HAT2 plasmid; 4) a fourth treatment co-bombarded the dCas9-VP64 plasmid and the dCas9-HAT2 plasmid; and 5) a fifth treatment used as a control that received no bombardment treatment. Each of treatments 1-4 further comprised on a second bombardment carrier disk providing to gold particles used for the bombardments equal amounts of DNA plasmids PHP89613 (SEQ ID NO: 203), PHP89611 (SEQ ID NO: 205), and RV038531 (SEQ ID NO: 206) for targeting the WUS2 and ODP2 BBM genomic target sites. As described above, microspore-derived cells cultured for 14 days at 28° C. under dark conditions were collected using a 70-micron cell strainer, washed, and transferred to a tissue culture media plate. Each plate of 14-day old cells was bombarded with two carrier disks as described above. The plates were then cultured for 8 days at 28° C. under dark conditions and then scored for the presence of responsive cells per treatment relative to the no treatment control.

Treated cells from the first treatment using the dCas9-CBF1A plasmid alone exhibited a 71% improvement in responsive cells relative to the no treatment control. Treated cells from the second treatment using the dCas9-VP64 alone exhibited an 8% improvement in responsive cells relative to the no treatment control. Treated cells from the third treatment using the combined dCas9-CBF1A plasmid and dCas9-HAT2 plasmid produced responsive cells equal to the responsive cell in the no treatment control. Treated cells from the fourth treatment using the combined dCas9-VP64 plasmid and dCas9-HAT2 plasmid exhibited a 50% improvement responsive cells relative to the no treatment control.

These results indicate that combinatorial treatments of maize microspore cultures from recalcitrant genotypes will likely require optimization of the combinations of so-called "synthetic transcription factors" and the dCas9 translational fusion proteins used here, to provide to a microspore-derived embryoid. It is expected that plasmid combinations comprising a dCas9 histone demethylase, a dCas9 histone acetyltransferase, and a dCas9 transcriptional activator, or any combinations thereof, will further improve cellular reprogramming towards an embryogenic cell fate in a plant cell with an initial, non-embryogenic regulatory state. It is also expected that certain genotypes and/or cells exhibiting varying degrees of cellular reprogramming, for example in response to the tassel pretreatment or the microspore embryogenesis response initiated during in vitro cell culture may require different cellular reprogramming agent activities in a manner dependent on the timing or duration of the cell fate reprogramming.

It is also expected that improved cellular reprogramming will be achieved in response to treating a cell with a combination of gRNA molecules. For example, wherein different gRNA molecules enable recruiting dCas9 translational fusion protein activity to a multitude of target loci, for example loci encoding the embryogenesis factors described in Table 6 and/or morphogenic genes.

It is expected that bombarding and/or contacting microspores with one DNA plasmid having a polynucleotide with multiple expression cassettes, for example a polynucleotide comprising a first expression cassette encoding a for dCas9-transcriptional activator translational fusion protein, a second expression cassette encoding dCas9 histone acetyltransferase translational fusion protein, and a third expression cassette capable of providing one or more gRNA molecules, will provide further improvements in cellular reprogramming. It is expected that this improvement will result in an increased frequency for each treated cell to be contacted with one plasmid with three activities in comparison to the likelihood that each treated cell can successfully be contacted with multiple DNA plasmids, wherein each plasmid has one activity.

E. Chromosome Doubling Method to Obtain a Microspore-Derived Doubled Haploid

For any method of this Example 7, an embryogenic microspore-derived cell that germinates into a plant can be transferred to a medium containing a chromosome doubling (or mitotic inhibitor) agent to create a doubled haploid plant. For example, treatments using colchicine concentrations of 0.1-1.0 g/ml that cause mitotic arrest of dividing cells at metaphase by interfering with microtubule organization can be used.

Example 8: Paternal Doubled Haploid Method Using Improved Cellular Uptake of Cellular Reprogramming Agents The methods of the present disclosure improve the efficacy of maize paternal haploid plant production by contacting a plant cell with a heterologous protein comprising a dCAS9 translational fusion protein as described above fused to a cell penetrating peptide (CPP) motif. The fusion protein is purified using the protein expression methods described above and recruited to a target locus as described above.

To improve cellular delivery and/or cellular uptake of the cellular reprogramming peptides disclosed herein, the methods of the present disclosure further comprise the use of a translational fusion peptide containing a cell penetrating peptide (CPP), often at the N- or C-terminus of a protein. Cell penetrating peptides useful in the cellular reprogramming methods of the present disclosure for improving delivery and/or uptake of the cellular reprogramming polypeptides into a plant cell, for example into an isolated microspore, include but are not limited to CPPs such as the *Z. mays* knotted1 CPP (ZM-KNT1 CPP; SEQ ID NO: 48 and SEQ ID NO: 49), the *Saccharomyces pombe* TP10 CPP (SP-TP10 CPP; SEQ ID NO:50 and SEQ ID NO: 51), the *Candida albicans* Zebra CPP (CA-Zebra CPP; SEQ ID NO: 52 and SEQ ID NO: 53), the PEP1 CPP (PEP1 CPP; SEQ ID NO: 54 and SEQ ID NO: 55), the HIV-1 TAT CPP (HIV-1 TAT CPP; SEQ ID NO: 56 and SEQ ID NO: 57), and a gamma-zein cell penetrating peptide (GZ CPP; SEQ ID NO: 58 and SEQ ID NO: 59).

Delivery of any of the cellular reprogramming components described above is improved by using CPP-mediated protein delivery, and thus, is an alternative method that potentially mitigates any risks associated with the particle bombardment methods as described above. It is expected that the use of CCPs in the cellular reprogramming methods of the disclosure will improve cellular reprogramming by altering the initial cell fate of a non-embryogenic wild type microspore. For example, by providing a CPP-dCas9 histone demethylase, a CPP-dCas9 histone acetyltransferase, a CPP-dCas9 transcriptional activator, or any combination thereof, to a microspore with an initial non-embryogenic regulatory state, it is expected that cellular reprogramming of the cell will be improved, thereby allowing for a non-genetically engineered microspore-derived plant to be obtained. Such treated microspore cells can be analyzed for morphological changes and such embryogenic cells can be cultured in vitro using standard methods.

It is also expected that improved cellular reprogramming can be achieved using a combination of gRNA molecules, wherein each gRNA results in binding of a CPP-dCas9 translational fusion proteins to a unique, independent genomic target site, for example endogenous loci with sequence homology to the DNA sequences as described in Table 6 and/or morphogenic gene sequences. Such simultaneous binding to multiple loci is expected to result in altering the gene regulatory state of multiple target loci thereby improving the recovery of a microspore-derived haploid plant, notably for elite maize inbreds, that otherwise are typically non-responsive and non-embryogenic. When such a cell is treated with a chromosome doubling agent, it is expected to result in production of a non-genetically engineered maize doubled haploid plant Example 9: Methods Improving Maize Paternal Doubled Haploid Productivity Using Embryogenesis Factors The following experiments demonstrate delivery of a T-DNA containing chemically inducible expression cassettes containing an embryogenesis factor described in Table 6 and/or a morphogenic developmental gene whereby microspore embryogenesis is improved.

Two plasmids, RV028329 (embryogenic control plasmid) and RV028330 (experimental plasmid), are compared. Both plasmids contain expression cassettes expressing a WUS and ODP2 peptide operably linked to regulatory elements that is chemically-inducible. These plasmids both contain the same expression cassettes with the following primary feature elements; (a) a WUSCHEL expression cassette; TET OP1+NOS PRO (ALT1)+ZM-WUS2+PINII TERM (SEQ ID NO: 93), (b) an ODP2 expression cassette; UBI1ZM PRO (TR2)+(3×)TET OP1+UBI1ZM 5UTR+SB-UBI INTRON1+ZM-ODP2+PINII TERM (SEQ ID NO: 94), (c) a sulfonylurea-responsive repressor expression cassette; UBI1ZM PRO+UBI1ZM 5UTR+UBI1ZM INTRON1+ESR (L15-20)+PINII TERM (SEQ ID NO: 95), (d) a selectable marker expression cassette; SB-ALS PRO+ZM-ALS (HRA) (TR1)+PINII TERM (SEQ ID NO: 96), and (e) expression cassettes containing the CRE/lox recombination system flanking a WUS2/ODP2 co-expression cassette (SEQ ID NO: 97), wherein CRE is operably linked to a promoter allowing excision of WUS2/ODP2/CRE cassettes after transformation, thereby allowing regeneration of transgenic plants containing only expression cassettes (a) to (d).

Plants transformed using RV028330 (experimental plasmid) will additionally contain an expression cassette encoding the coding sequence for a gene dpzm07g031470.1.1, herein called (ZM-CYCD2), namely, CAMV35S PRO+(3×) TET OP1+OMEGA 5UTR+ADH1 INTRON1+ZM-CYCD2+PINII TERM (SEQ ID NO: 98).

Both plasmids include a polypeptide that is a sulfonylurea-responsive repressor protein that binds to an operator sequence controlled by a ligand comprising a sulfonylurea compound. The repressor protein binds specifically to the operator in the absence of a sulfonylurea ligand. Upon providing a sulfonylurea compound to a transgenic cell expressing a sulfonylurea-responsive repressor protein, the sulfonylurea binds to the repressor protein to form a complex that modifies the binding properties of the repressor protein to the operator, and results in de-repression of the operator sequence. In this manner, a "chemical switch-mediated expression" system is used for testing the effect of each embryogenesis factor in Table 6, for example a polynucleotide comprising SEQ ID NO: 1, 2, 3, 4, 5, 6, 7, 8, 9, 10, 11, 12, 13, 14, 15, or 16. Each polynucleotide can be transferred into an expression cassette as shown for SEQ ID NO: 98, wherein the specific embryogenesis factor being used corresponds to the embryogenesis factor dpzm07g031470.1.1 (ZM-CYCD2) (polynucleotide SEQ ID NO: 5; polypeptide SEQ ID NO: 21).

Transgenic plants containing either plasmid RV028329 or RV028330 were created by *Agrobacterium*-mediated transformation as described above. After *Agrobacterium*-mediated transformation, somatic embryo maturation and regeneration, T$_0$ plants were analyzed by qPCR to identify single copy, hemizygous individuals containing either plasmid. Such plants were grown and the silks were fertilized using wild type pollen to create seed, wherein approximately half of the seeds are hemizygous T$_1$ seed and half are wild type T$_1$ seed.

Initial event characterization of T$_0$ tassels was performed using isolated microspores as described above. For induction of morphological developmental gene expression, cultured microspore cells were treated with ethametsulfuron, for example at 0.1 to 1 ppm. Initial results showed that maize paternal doubled haploid productivity using the embryogenesis factors disclosed in Table 6 and a morphogenic gene was improved following gene activation in response to the ethametsulfuron treatment.

Given a sample size of one tassel per unique T$_0$ event, it was not possible to further characterize the embryogenic effect at this generation. Further evaluation for the improvement of microspore embryogenesis in response to co-expression of an embryogenesis factor with a morphogenic developmental gene will be performed using a subsequent generation. It is expected that co-expressing any of the embryogenesis factors disclosed in Table 6 with a morphogenic gene will further improve the frequency of microspore embryogenic responses in treated microspores. It is also expected that such improved responses can include improving the quantity, or number of, responding cells, as well as improving the quality of the microspore-derived embryo, including but not limited to improved cellular organization, morphological embryogenic development, and or plantlet regeneration useful for obtaining fertile, doubled haploids plants.

Example 10: Paternal Doubled Haploid Method Using Improved in Planta Cellular Reprogramming Methods The following experiments demonstrate that contact with a plasmid containing i) an expression cassette encoding an embryogenesis factor disclosed in Table 6, ii) a morphogenic developmental gene, and iii) and combinations thereof can improve recovery of non-transgenic, microspore-derived haploid plants.

In the cellular reprogramming methods of the present disclosure, a plasmid is delivered and stably integrated into the DNA of a plant cell. The integrated DNA that is used comprises an expression cassette designed to improve microspore embryogenesis in planta prior to microspore isolation.

For these experiments, two plasmid designs are tested. A first plasmid contains an expression cassette containing a polynucleotide (SEQ ID NO: 319) encoding the Ms44 signal peptide sequence (SEQ ID NO:320) fused to a polynucleotide (SEQ ID NO: 363) encoding a WUSCHEL polypeptide fused to a glucocorticoid receptor (GR) (SEQ ID NO 364) and the Ms44 terminator sequence (SEQ ID NO: 327) operably linked to the *Zea mays* Ms44 promoter (SEQ ID NO: 318).

A second plasmid contains an expression cassette containing a polynucleotide (SEQ ID NO: 319) encoding the Ms44 signal peptide sequence (SEQ ID NO:320) fused to a polynucleotide (SEQ ID NO: 363) encoding a WUSCHEL polypeptide fused to a glucocorticoid receptor (GR) (SEQ ID NO: 364), a polycistronic linker ("T2A"; SEQ ID NO: 101 encoding SEQ ID NO: 102), a translational fusion protein comprising the DNA sequence encoding an embryogenesis factor selected from any one of the DNA sequences shown in Table 6; consisting of SEQ ID NOS: 1-16 with C-terminal fusions using any one of the cell penetrating peptides including, but are not limited to, a *Z. mays* knotted1 CPP (ZM-KNT1 CPP; SEQ ID NO: 48 encoding SEQ ID NO: 49), the *Saccharomyces pombe* TP10 CPP (SP-TP10 CPP; SEQ ID NO: 50 encoding SEQ ID NO: 51), the *Candida albicans* Zebra CPP (CA-Zebra CPP; SEQ ID NO: 52 encoding SEQ ID NO: 53), the PEP1 CPP (PEP1 CPP; SEQ ID NO: 54 encoding SEQ ID NO: 55), the HIV-1 TAT CPP (HIV-1 TAT CPP; SEQ ID NO: 56 encoding SEQ ID NO: 57), and the gamma-zein cell penetrating peptide (GZ CPP; SEQ ID NO: 58 encoding SEQ ID NO: 59) (see U.S. Pat. No. 8,581,036, incorporated herein by reference in its entirety), and the Ms44 terminator sequence (SEQ ID NO: 327) operably linked to the *Zea mays* Ms44 promoter ("ZM-Ms44 PRO"; SEQ ID NO: 318).

Each construct facilitates protein expression and transport of the expressed proteins from a tapetum cell to the locule of the anther, allowing delivery and uptake into a microspore cell. In the cellular reprogramming methods of the present disclosure, after uptake of the WUSCHEL-GR fusion protein into a microspore, the protein is conditionally localized to the nucleus by external application of animal hormone analogs during in vitro tissue culture, thereby resulting in controlled induction of cellular reprogramming. For the methods using the second plasmid containing both a WUSCHEL-GR fusion protein and an embryogenesis factor-CPP fusion protein, the WUSCHEL-GR fusion protein is conditionally localized to the nucleus by external application of animal hormone analogs into the in vitro tissue culture while the embryogenesis factor-CPP fusion protein can be constitutively active.

$F_1$ hybrid embryos are produced by crossing two inbred parental lines where one parent is the female parent (ear donor) and the second parent is the male parent (pollen donor). Using standard methods the two plant varieties can be cross fertilized in a manner preventing any outcrossing to generate $F_1$ hybrid embryos. When the two parents are each homozygous at all loci genome wide, it is expected that the resultant embryo will be heterozygous at all loci genome-wide. The method of the present disclosure collects an immature $F_1$ hybrid embryo for treatment as described below.

In the current example, immature $F_1$ hybrid embryos are transformed using one the two plasmids described above, wherein each plasmid is incorporated into an *Agrobacterium* transformation vector. *Agrobacterium*-mediated transformation is preformed using standard protocols. Alternatively, transformation vectors can be introduced into plant cells using biolistic transformation methods, or any other standard methods.

Following transformation and selection of hemizygous transformed plants for each construct, the plants are grown, staged, and tassels harvested when anthers contain uninucleate microspores. Preferentially, the tassels may be pre-treated with a cold stress treatment for 14 days at approximately 8 to 10° C. Microspores are isolated from the $T_0$ hemizygous tassels and the cells are cultured in a 9% sucrose induction medium.

Alternatively, a wild type embryo can be transformed, regenerated and a single-copy hemizygous plant can be propagated to allow the recovery of a progeny that is homozygous for the presence of the transgene construct. Such a homozygous line can be used as a parent in a genetic cross with a second line to create a hemizygous $F_1$ hybrid.

Regardless of directly transforming an immature $F_1$ hybrid embryos, as described above, or preferentially creating and using a homozygous transgenic line in a genetic cross, the methods of the present disclosure provide a copy of the transgene from the transformed parent that is useful for expressing cellular reprogramming agents.

One such agent is a WUS-GR translational fusion protein whereby activity is dependent on the presence of a glucocorticoid, such as the synthetic steroid hormone dexamethasone. In the absence of the dexamethasone, the WUS-GR translational fusion protein is inactive and localized in the cytoplasmic. In the presence of dexamethasone, hormone binding allows the WUS-GR translational fusion protein to enter the nucleus, thereby allowing the fusion protein to activate microspore embryogenesis.

In the current example, activating embryogenesis is further improved by combining a WUS-GR translational fusion protein with the protein activity conferred by an expression cassette containing an embryogenesis factors useful for cellular reprogramming as described in Table 6, for example by expressing an embryogenesis factor-CPP translational fusion protein. Thus, this method enables simultaneous activity for one or more cellular reprogramming agents in a treated nucleus. Activities in the nucleus allow cellular reprogramming in response to the simultaneous activity of at least two cellular reprogramming agents.

Haploid microspores generated by any of the methods disclosed herein are contacted with an amount of a chromosome doubling agent to promote chromosome doubling and to regenerate homozygous diploid plants from the treated haploid microspore. The haploid microspore cells may be in contact with the doubling agent before, during, or after initiation of microspore embryogenesis, embryo maturation, or plant regeneration. Various chemicals such as those listed in Table 2 have chromosome doubling properties, for example colchicine at concentrations of 0.1-1.0 g/ml.

It is expected that cellular reprogramming efficiencies will be improved in response to methods using in planta expression of cellular reprogramming agents. In particular, it is expected that cellular reprogramming efficiencies will be further improved with the use of a second plasmid wherein isolated microspores are contacted in planta with both a morphogenic gene translational fusion protein such as a WUS-GR translational fusion protein and an embryogenesis factor-CPP translational fusion protein such as any of the embryogenesis factors disclosed in Table 6 providing to the nucleus the simultaneous activity of two cellular reprogramming agents relative to only the singular activity of a morphogenic gene translational fusion protein such as the WUS-GR translational fusion protein.

It is also expected that the combinations of morphogenic developmental genes can be co-expressed with one, or possibly multiple, embryogenesis factors, wherein the response is further improved when using multiple embryogenesis factors in comparison to in planta cellular reprogramming methods using fewer cellular reprogramming agents.

Example 11: Method Improving Maternal Doubled Haploid Induction Frequency of a Haploid Inducer Line Methods of the present disclosure relate to improving a haploid inducer line by transforming an inducer line so that it expresses cellular programming agents capable of improving embryogenesis in maternal haploid embryos. The transformed haploid inducing line is used as a parent in a cross between two plants. During pollination with pollen from the transformed haploid inducer line, expression of the cellular programming agents occurs by expressing the cellular programming agents from the paternal allele before, during, or after fertilization and pollinating an embryo sac cell, particularly an egg cell to improve the production of maternal haploids. Activity of the cellular reprogramming agent in or near the embryo sac cell, particularly the egg cell, stimulates embryogenesis thereby improving the production of maternal haploids. These experiments demonstrate improving the productivity for creating maize doubled haploids using maternal (gynogenic) doubled haploid production methods.

Maize inbred line development methods using the maternal (gynogenic) doubled haploid production fertilize the ear of a plant, for example a plant that is a first-generation cross, or progeny thereof, with pollen from a so-called "haploid inducer" line. A haploid induction cross performed by pollinating a female flower (donor ear) with pollen of a haploid inducer strain (donor pollen) results in elevated levels of ovules containing only the haploid maternal genome, relative to inheriting a copy of both the maternal and paternal genome. Such a maternal haploid embryo is the product of meiosis and each maternal ovule is a unique meiotically recombined haploid genome. Such immature maternal haploid embryos can be isolated and treated using in vitro tissue culture methods that include chromosome doubling treatments to generate maternal doubled haploid recombinant populations.

An isolated maternal haploid embryo from a haploid induction cross can fail to regenerate into a fertile, doubled haploid plant. The methods of the present disclosure improve the production of doubled haploid plants applicable to maternal gamete doubled haploids in maize, including methods to increase the quantity of induced haploid embryos, as well as to improve the quality of the induced haploid embryo with respect to increasing the frequency of regenerating fertile, doubled haploid plants from the induced haploid embryos.

The methods of the present disclosure also provide in planta protein delivery methods to a maternal parent of a haploid induction cross comprising transforming a maize haploid inducer line to stably integrate and express a heterologous expression cassette providing improved cellular reprogramming when this transformed haploid inducer line is crossed with the maternal parent. Thus, the methods of the present disclosure can improve the quantity, or number of, maternal haploid embryos, as well as improve the quality of the maternal haploid embryo, including but not limited to improved growth in vitro and/or improved responsiveness to chromosome doubling methods, such as colchicine treatments.

In these experiments two plasmids are compared. In this experiment, Plasmid #1 (a control plasmid) is used containing an expression cassette with the following feature elements; (a) UBI1ZM PRO+UBI1ZM 5UTR+UBI1ZM INTRON1+DS-RED2+PINII TERM (SEQ ID NO: 99) and (b) expression cassettes containing the CRE/lox recombination system flanking a WUS2/ODP2 co-expression cassette (SEQ ID NO: 97), wherein CRE is operably linked to a promoter allowing excision of WUS2/ODP2/CRE cassettes after transformation, thereby allowing regeneration of transgenic plants containing only expression cassette (a) of the control plasmid (Plasmid #1). Plasmid #2 (an experimental plasmid) is used containing an expression cassette with the following feature elements; (a) UBI1ZM PRO+UBI1ZM 5UTR+UBI1ZM INTRON1+DS-RED2+PINII TERM (SEQ ID NO: 99), (b) Pv-EGG CELL PRO (TR1)+ZM-CYCD2+PINII TERM (SEQ ID NO: 100), wherein this expression cassette contains the coding sequence for embryogenesis factor dpzm07g031470.1.1. (SEQ ID: 5), and (c) an expression cassette containing the CRE/lox recombination system flanking a WUS2/ODP2 co-expression cassette (SEQ ID NO: 97), wherein CRE is operably linked to a promoter allowing excision of WUS2/ODP2/CRE cassettes after transformation, thereby allowing regeneration of transgenic plants containing only expression cassettes (a) and (b) of the experimental plasmid (Plasmid #2).

Alternatively, methods of the present disclosure can use strategies for multigene co-expression using "self-cleaving" 2A peptides that mediate "cleavage" of polypeptides during translation in eukaryotic cells, for example the polycistronic linker "T2A" (SEQ ID NO: 101 encoding SEQ ID NO: 102). Combinations of polynucleotides containing any of the embryogenesis factors shown in Table 6 (SEQ ID NOS: 1-16), wherein one polynucleotide is fused to a second polynucleotide using the T2A polycistronic linker sequence are useful in the cellular reprogramming methods of the present disclosure. The cellular reprogramming methods of the present disclosure can also include polynucleotides comprising a combination of more than any two selected embryogenesis factors shown in Table 6 (SEQ ID NOS: 1-16), wherein the T2A polycistronic linker sequence is inserted between each coding sequence.

As shown above, it was also demonstrated that improved efficacy of cellular reprogramming was achieved when DNA SEQ ID NO: 5 encoding embryogenesis factor dpzm07g031470.1.1. was co-expressed with a cyclin dependent kinase, for example CDKA1 or CDKA3. Further improvements were shown above when these combinations were expressed with either the WUS or BBM/ODP2 proteins, thus demonstrating that improved cellular reprogramming can be achieved using combinations of embryogenesis factors with morphogenic developmental genes. Cellular reprogramming methods expressing multiple proteins from one expression cassette are useful in the method of the present disclosure, for example, combinations including but not limited to the exemplary sequences shown in Table 10.

TABLE 10

Cellular reprogramming factor combination for improving maternal doubled haploid induction

| Expression Cassette Name | Feature Elements | SEQ ID NO: |
|---|---|---|
| WUS alone | PV-EGG CELL PRO (TR1) + linker + WUS2 + PINII TERM | 103 |
| WUS + DZ470 | PV-EGG CELL PRO (TR1) + linker + WUS2(TR) + T2A + DZ470 + PINII TERM | 104 |
| WUS + DZ470 + CDKA1 | PV-EGG CELL PRO (TR1) + linker + WUS2(TR) + T2A + DZ470(TR) + T2A + CDKA1 + PINII TERM | 105 |
| WUS + DZ470 + CDKA3 | PV-EGG CELL PRO (TR1) + linker + WUS2(TR) + T2A + DZ470(TR) + T2A + CDKA3 + PINII TERM | 106 |
| BBM alone | PV-EGG CELL PRO (TR1) + linker + ZM-ODP2 + PINII TERM | 107 |
| BBM + DZ470 | PV-EGG CELL PRO (TR1) + linker + ZM-ODP2(TR) + T2A + DZ470 + PINII TERM | 108 |
| BBM + DZ470 + CDKA1 | PV-EGG CELL PRO (TR1) + linker + ZM-ODP2(TR) + T2A + DZ470(TR) + T2A + CDKA1 + PINII TERM | 109 |
| BBM + DZ470 + CDKA3 | PV-EGG CELL PRO (TR1) + linker + ZM-ODP2(TR) + T2A + DZ470(TR) + T2A + CDKA1 + PINII TERM | 110 |

The methods of the present disclosure use a cellular reprogramming plasmid having an expression cassette with a polynucleotide comprising a dCas9 translational fusion protein cellular reprogramming factor, such as a fusion protein shown in Table 9 (SEQ ID NOS: 73-77) and one or more gRNA, such as the gRNA described herein to effect cellular reprogramming. The expression cassettes can be operably linked to a tissue-preferred promoter or an inducible promoter.

For these experiments, a maize plant selected and/or derived from the group consisting of Stock 6, RWK, RWS, UH400, AX5707RS, and NP2222-matl, or any haploid inducer line is transformed. The haploid inducer line may contain a fluorescent reporter expression construct, such as a green, yellow, or red fluorescent reporter gene, that allows the fluorescence detection in the embryos at an early developmental stage and/or an allele of the anthocyanin genes, such as the R1-scm allele, expressing in embryos at the early developmental stage. Together, both marker genes allow identifying diploid and haploid embryos based on the presence or absence of these reporter gene products, respectively.

Transformed haploid inducer plants are created using the methods described above, including transformation methods comprising expression cassettes containing the CRE/lox recombination system flanking a WUS2/ODP2 co-expression cassette (SEQ ID NO: 97), wherein CRE is operably linked to a promoter allowing excision of WUS2/ODP2/CRE cassettes after transformation, thereby allowing regeneration of transgenic plants containing only expression cassettes using the exemplary sequences including but not limited to the polynucleotides of SEQ ID NOS: 103-110 described in Table 10 which are expected to provide to an egg cell embryogenic protein activities. Typical promoters useful to provide to an egg cell the embryogenic protein activity include the maize oleosin promoter or maize LEC1 promoter, or other egg cell promoters, such as Pv-EGG CELL PRO (TR1) promoter (see Table 10).

In the current example, transgenic plants containing the expression cassettes described in Table 10 are regenerated and $T_0$ plants are analyzed by qPCR to identify single copy, hemizygous individuals containing each plasmid. $T_0$ plants that are determined to be single copy, hemizygous plants are propagated and used as haploid inducers for haploid induction crosses. These transformed single copy, hemizygous inducer plants are grown and are used as pollen donors to fertilize a donor ear of a female plant.

The ears of the female parent plants are shoot-bagged before silk emergence to avoid any foreign pollen contamination. The silks of the ears on the plants of the female parent plants are pollinated with viable pollen grains collected from the anthers of the transformed male parent plants (transformed haploid inducer plants). At approximately 9-14 days after pollination, the immature ears are harvested. The ears are surface sterilized in 30% Clorox bleach plus 0.5% Micro detergent for 20 minutes and rinsed two times with sterile water.

The haploid embryos are isolated based on the identification of the visible marker gene(s) in the inducer lines. For example, if the inducer contains a fluorescent reporter gene or an anthocyanin biosynthesis gene operably linked to a promoter that allows gene expression in the embryos at an early developmental stage. By using this kind of visible marker, haploid embryos without DS-RED2 or anthocyanin expression can be identified from the diploid embryos with DS-RED2 or anthocyanin expression.

The haploid maize embryos are isolated using a scalpel and placed on a medium containing colchicine. After approximately 24 hours the embryos are transferred onto a medium without colchicine and placed in the dark. After approximately 6-10 days each plantlet can be transferred to a light culture room. Approximately 7-14 days later, plantlets are transferred to flats containing potting soil and grown for 1 week in a growth chamber, subsequently grown an additional 1-2 weeks in the greenhouse, then transferred to pots and grown to maturity. These plants will be a heterogeneous population of doubled haploid plants. These fertile doubled haploid maize plants can be propagated by self-fertilization, or outcrossing, and the progeny evaluated for breeding purposes.

An alternative way to accomplish the methods of the present disclosure is to operably link each expression cassette to a promoter regulatory element that is active during microspore and/or pollen development. For example, the maize promoters PG47 (SEQ ID NO: 118) or PG67 are promoters active during microspore and/or pollen development. In this manner, the expression cassettes using the exemplary sequences including but not limited to the polynucleotides of SEQ ID NOS: 103-110 described in Table 10 can provide the embryogenic protein activities directly to an egg cell.

It is expected that the haploid embryos in each ear will be produced at a frequency of about 5-12% after pollination when using the haploid inducer or the haploid inducer transformed with plasmid #1 (DS-RED2 expression only).

Improved haploid induction frequencies are expected when using plasmid #2 containing a polynucleotide comprising any of the embryogenesis factors in Table 6 (SEQ ID NOS: 1-16; encoding polypeptides SEQ ID NOS: 17-32, respectively). Additionally, given the improved levels of embryogenesis conferred by embryogenesis factor dpzm07g031470.1.1; (polynucleotide SEQ ID NO: 5, polypeptide SEQ ID NO: 21) when co-expressed with a cyclin dependent kinase (CDKA1 or CDKA3) (see FIG. 2A and FIG. 2B) it is expected that expressing such combinations in the present method will improve haploid induction. For example, relative to plasmid #1, expressing a morphogenic developmental gene is expected to lead to an improved result, and expressing a morphogenic developmental gene and a cyclin is expected to lead to further improved results, while expressing a morphogenic developmental gene and a cyclin and a cyclin dependent kinase is expected to lead to yet further improved results.

It is also expected that activity of a dCas9-activator RNP comprising a dCas9 translational fusion protein complexed with one or more gRNA provided to an egg sac cell, such as an egg cell, capable of expressing a locus encoding a morphogenic developmental gene and/or a novel embryogenesis factor can improve maternal haploid induction.

It is further expected that combinations of expressed embryogenesis factors can result in increased levels of haploid induction, wherein the activity is provided as proteins expressed from a polynucleotide or resulting from dCas9-mediated up-regulation of DNA comprising the maternal haploid genome. Such combinations of expressed embryogenesis factors may or may not be co-expressed with a morphogenic developmental gene. It is expected that the method can also result in improved haploid embryo culture responses in vitro, including improvements to the reproductive success of a regenerated double haploid plant.

The methods described here can provide direct protein delivery to an egg cell using expression cassettes operably linked to a promoter regulatory element active in the male gamete. Such methods are also expected to lead to improved haploid induction frequencies and/or improvements to reproductive success.

Together, these methods can enhance the quantity and/or quality of a maternal haploid embryos.

Example 12: Method Improving Maternal Haploid Induction

Methods of the present disclosure provide haploid inducer lines by transforming a non-haploid inducer line so that it expresses cellular programming agents capable of improving embryogenesis in maternal haploid embryos. The transformed line is used as a parent in a cross between two plants. During female gametogenesis, expression of cellular programming agents occurs and activity of the cellular reprogramming agent in or near the embryo sac cell, particularly the egg cell, stimulates embryogenesis. Fertilization with wild type pollen can be required for endosperm formation (pseudogamy, or pseudogamous endosperm). These experiments demonstrate improving the production of creating maize doubled haploids using maternal (gynogenic) doubled haploid production methods.

Methods for further improving haploid induction using an expression cassette encoding an AP2 transcription factor combined with other protein activities during female gamete development are provided.

For such AP2 domain transcription factor methods, *Agrobacterium*-mediated stable plant transformation was employed as described above. For example, the ODP2/BBM nucleotide sequence introduced into the plant was under the control of a tissue specific promoter that is active in a haploid cell or tissue or was under the control of a promoter that is active during female gamete development. Alternatively, the ODP2/BBM nucleotide sequence is under the control of an inducible promoter and the application of the inducer allows expression of the ODP2/BBM sequence therein. Alternatively, the promoter used can be both inducible and tissue-preferred. For example, the promoter can be both haploid-tissue specific and inducible.

A promoter expressed in the egg cell of the plant is useful for regulating ODP2/BBM expression to promote maternal haploid induction, resulting in a percentage of the progeny to be haploid having half the number of chromosomes compared to the parent. Exemplary promoters including but are not limited to AT-DD5, AT-DD31, AT-DD65, or more preferentially the ZM-DD45 promoter. Additionally, using a *Zea mays* egg cell promoter operably linked to a polynucleotide encoding the ODP2/BBM protein and a 3' UTR from a *Zea mays* egg cell gene can be used.

A. Maternal Haploid Induction in Response to Parthenogenesis Activated by a Truncated BBM In the methods of the present disclosure, two plasmids were used with the ODP2/BBM peptide operably linked to either the egg cell ZmRKD2 promoter or the Pv-EGG CELL PRO (TR1) promoter, resulting in a ZmRKD2pro::BBM$^{404}$ and a Pv-EGG CELL PRO (TR1)pro::BBM$^{404}$ expression cassette (SEQ ID NO: 119 and SEQ ID NO: 120, respectively). Each expression cassette expressed a truncated ODP2/BBM peptide, for example 404 amino acid residues of the ODP2/BBM peptide carboxy terminal region ("BBM$^{404}$"; SEQ ID NO: 121). Transformed non-haploid inducer plants were created using the methods described above, including transformation methods comprising expression cassettes containing the CRE/lox recombination system flanking a WUS2/ODP2 co-expression cassette (SEQ ID NO: 97), wherein CRE was operably linked to a promoter allowing excision of WUS2/ODP2/CRE cassettes after transformation. Regenerated transgenic plants containing either the ZmRKD2pro::BBM$^{404}$ of the Pv-EGG CELL PRO (TR1)pro::BBM$^{404}$ expression cassette, were grown to evaluate ODP2/BBM protein activity in an egg cell in respect to cellular reprogramming and maternal haploid induction (see FIG. 6B).

The ears of the transgenic female parent plants were shoot-bagged before silk emergence to avoid any foreign pollen contamination. The silks of the ears on the plants of the female parent plants were pollinated with viable pollen grains collected from the anthers of the male non-haploid inducer parent plants constitutively expressing a cyan fluorescent protein (CFP) color marker. At approximately 9-14 days after pollination, the immature ears were harvested. The ears were surface sterilized in 30% Clorox bleach plus 0.5% Micro detergent for 20 minutes and rinsed two times with sterile water.

The haploid embryos were isolated based on the absence of visible CFP expression in comparison to the diploid embryos expressing CFP. The percent (%) of CFP negative embryos were scored per unique event using the number of haploid embryos in hemizygous $T_0/F_2$ expressing ODP2/BBM divided by the total number of embryos isolated. A total of 12 unique, single copy events per plasmid were used, resulting in approximately 2,750 total isolated embryos per plasmid.

For the purposes of ploidy analysis, CFP-negative embryos were cultured, plantlets regenerated, leaf tissue sampled, nuclei isolated, and the ploidy level per plantlet was determined using standard flow cytometry methods.

Additionally, methods of the present disclosure can use a polycistronic linker ("T2A"; SEQ ID NO: 101 encoding SEQ ID NO: 102) to create a series of expression cassettes wherein a polynucleotide encodes the ODP2/BBM peptide ("BBM$^{404}$", SEQ ID NO: 121) and any of the embryogenesis factor (polynucleotide SEQ ID NOS: 1-16; encoding polypeptide SEQ ID NOS: 17-32, respectively). The methods of the present disclosure can also comprise expression cassettes wherein a combination of morphogenic developmental genes, any of the embryogenesis factors disclosed herein, and optionally cyclin dependent kinases are co-expressed, including any combinations thereof. These constructs are also expected to be useful in the methods of the present disclosure.

In the methods of the present disclosure, these two plasmids were each operably linked to a promoter expressed in the egg cell of the plant. Alternatively, a method useful in the present disclosure is to operably link each expression cassette to a promoter regulatory element that is active during microspore and/or pollen development. For example, the maize promoters PG47 (SEQ ID NO: 118), PG67, or other such pollen-specific promoters that are active during microspore and/or pollen development. The expression cassettes using the exemplary sequences including but not limited to the polynucleotides for SEQ ID NOS: 103-110, described in Table 10, can directly provide protein activities to an egg cell.

Figure 6A:
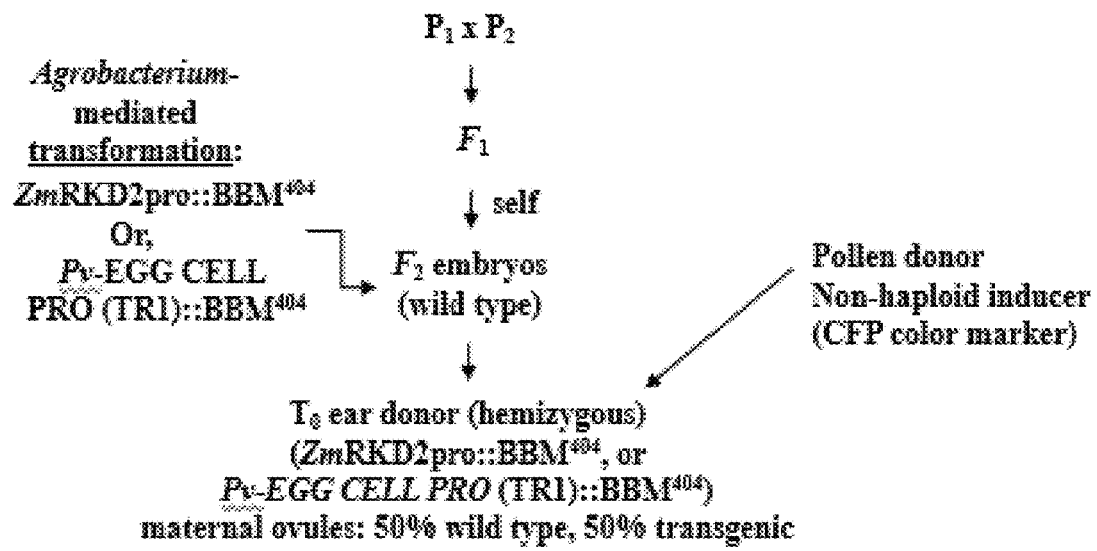
FIG. 6A shows a schematic of methods of maternal haploid induction using a truncated BBM (BBM$^{404}$) gene operably linked to an egg cell promoter, either the ZmRKD2 egg cell promoter or the egg cell Pv-EGG CELL PRO (TR1) egg cell promoter, resulting in a ZmRKD2pro::BBM$^{404}$ or a Pv-EGG CELL PRO (TR1) pro::BBM$^{404}$ expression cassette, respectively (SEQ ID NO: 119 and SEQ ID NO: 120, respectively).
Figure 6B:
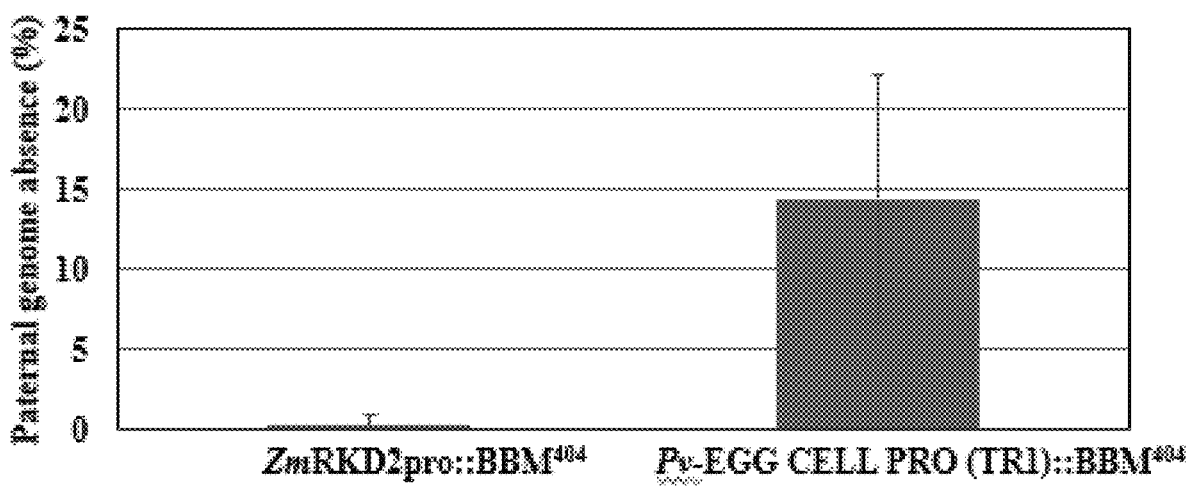
FIG. 6B shows the percentage of CFP-negative embryos lacking a paternal genome (paternal genome absence %; y axis) after transformation with a ZmRKD2pro::BBM$^{404}$ or a Pv-EGG CELL PRO (TR1) pro::BBM$^{404}$ expression cassette.

Evaluation of the two plasmids, each comprising the ODP2/BBM peptide operably linked to either the egg cell ZmRKD2 promoter or the Pv-EGG CELL PRO (TR1) promoter exhibited varying levels of haploid induction. For example, the percentage of CFP-negative haploid embryos in response to the ZmRKD2pro::BBM$^{404}$ expression cassette and a Pv-EGG CELL PRO (TR1)pro::BBM$^{404}$ expression cassette averaged 0.3% and 14.9% respectively (FIG. 6B). This result demonstrated the impact each respective promoter has on haploid induction, for example it is expected that possible variation in promoter strength and/or differences in spatiotemporal gene regulatory activity will further improve haploid induction.

To confirm that CFP-negative plants were indeed haploid plants, regenerated plants were sampled and leaf tissues were collected for ploidy analysis using standard flow cytometry methods. These results showed that the CFP-negative plants were indeed haploid. Additionally, DNA genotyping was performed for several individuals and inheritance patterns of segregating alleles across each chromosome were consistent with these plants being derived from a maternal haploid embryo.

It is expected that maternal haploid induction frequencies will be further improved by ectopically expressing an embryogenesis factor disclosed in Table 6, with or without the combined protein activity of a morphogenic developmental gene.

Alternatively, it is expected that ectopically expressing such combinations of the cellular reprogramming agents (an embryogenesis factor disclosed in Table 6 with or without a morphogenic gene) using promoters active in a male gametic cell can directly produce the protein activities in or near the embryo sac cell, such as the egg cell, to trigger embryogenesis that allows obtaining a haploid plant embryo.

B. Maternal Haploid Induction in Response to Parthenogenesis Activated by Full-Length BBM Maternal haploid induction was evaluated in response to parthenogenesis activated by a full-length BBM/ODP2 protein. In this experiment, $F_1$ embryos as described above, using the same biparental cross were collected and transformed with plasmid PHP94831 (SEQ ID NO: 416). Plasmid PHP94831 which expresses a full-length BBM/ODP2 protein rather than a truncated version was used to determine the impact, if any, on maternal haploid induction. The method performed here otherwise followed the steps described above, including the scoring of CFP-negative embryos as haploid embryos.

In response to expression of full-length BBM/ODP2 operably linked to the PV-EGG CELL PRO (TR1) promoter described above, an average CFP-negative, maternal haploid induction level of 28.7% was observed using ears collected from 13 unique, single copy events. The range of haploid induction of these sampled events varied from a 13% to a 35% haploid induction level. These result shows that full-length BBM/ODP2 activity improved maternal haploid induction in response to parthenogenesis in comparison to expression of a truncated BBM/ODP2 protein's activity.

C. Maternal Haploid Induction in Response to Parthenogenesis Activated by Truncated BBM and Cell Cycle Regulators Maternal haploid induction in response to an expression cassette containing combined gene activities was evaluated. The method of the present disclosure can use a polycistronic linker ("T2A"; SEQ ID NO: 101 encoding SEQ ID NO: 102) to create a series of expression cassettes wherein a polynucleotide encodes a first peptide, such as a ODP2/BBM peptide ("BBM$^{404}$", SEQ ID NO: 121) and a second peptide, such as an embryogenesis factor (polynucleotide SEQ ID NOS: 1-16; polypeptide SEQ ID NOS: 17-32, respectively). As shown above, the method of the present disclosure can also comprise a polycistronic expression cassette wherein a combination of embryogenesis factors and morphogenic developmental genes, and optionally a cyclin dependent kinase are co-expressed, including any combinations thereof. Examples of expression cassettes are described in Table 11.

biparental cross were collected, transformed, and grown to maturity under greenhouse conditions.

The ears of the transgenic female parent plants were shoot-bagged before silk emergence to avoid any foreign pollen contamination. The silks of the ears on the plants of the female parent plants were pollinated with viable pollen grains collected from the anthers of the male non-haploid inducer parent plants constitutively expressing a cyan fluorescent protein (CFP) color marker. At approximately 18 days after pollination, the immature ears were harvested. The ears were surface sterilized in 30% Clorox bleach plus 0.5% Micro detergent for 20 minutes and rinsed two times with sterile water.

The haploid embryos were isolated based on the absence of visible CFP expression in comparison to the diploid embryos expressing CFP. The percent (%) of CFP-negative embryos were scored per unique event per construct using the number of haploid embryos in hemizygous $T_0/F_2$ expressing ODP2/BBM divided by the total number of embryos isolated. Ploidy analysis was performed as described above.

As reported above, transformation with the BBM$^{404}$ expression cassette (SEQ ID NO: 126) resulted in a 14.9% maternal haploid induction level. In a total of 10 unique, single copy events containing the BBM$^{403}$+Dz470 expression cassette (SEQ ID NO: 127), CFP-negative embryos averaged 18.2% per event, a 22% increase in response to the activity of the Dz470 gene activity being co-expressed with the BBM$^{404}$ peptide. This truncated BBM peptide provided a similar somatic embryogenic response as described above, wherein a full length BBM peptide was used. It is also expected that Dz470 co-expression with a full length BBM peptide will further improve in planta maternal haploid induction levels.

In this experiment, 89 CFP-negative embryos were obtained in response to the BBM$^{403}$+Dz470 expression cassette and were analyzed for ploidy levels using flow cytometry methods. The results for this analysis indicated that 73 of the 89 (82%) CFP-negative embryos were indeed haploid, as expected, while the remaining 16 of 89 (18%) CFP-negative embryos had ploidy levels consistent with diploidized maternal haploid embryos. This result indicated that those 16 embryos had doubled chromosomes in response to the cell cycle activity conferred by Dz470. It is expected that further genotyping of these materials will confirm that each of the 16 embryos is a doubled haploid derived from an unfertilized egg cell that was the product of meiosis and was obtained without the need for a chemical chromosome doubling treatment.

TABLE 11

Haploid induction expression cassettes using truncated BBM/ODP2

| Sequence Name | Feature Elements | SEQ ID NO: |
|---|---|---|
| BBM$^{404}$ | PV-EGG CELL PRO (TR1)::BBM$^{404}$::PINII TERM | 126 |
| BBM$^{403}$ + Dz470 | PV-EGG CELL PRO (TR1)::BBM$^{403}$:T2A:DZ470::PINII TERM | 127 |
| BBM$^{403}$ + Dz470 + CDKA1 | PV-EGG CELL PRO(TR1)::BBM$^{403}$:T2A:DZ470(TR):T2A:CDKA1::PINII TERM | 128 |
| BBM$^{403}$ + Dz470 + CDKA3 | PV-EGG CELL PRO(TR1)::BBM$^{403}$:T2A:DZ470(TR):T2A:CDKA3::PINII TERM | 129 |

In this experiment, the BBM$^{403}$+Dz470 expression cassette (SEQ ID NO: 127) was substituted for the full length BBM/ODP2 expression cassette of plasmid PHP94831 and this construct was used for plant transformation as described above. In this experiment, $F_1$ embryos using the same It is expected that the BBM$^{403}$+Dz470+CDKA1 expression cassette (SEQ ID NO: 128) when used will further improve maternal haploid induction and it is expected that in planta chromosome doubling frequency in response to the cell cycle activity will also be provided. It is expected that other genes that impact the plant cell cycle will also provide in planta chromosome doubling.

While the above expression cassette used encoded a BBM peptide, it is expected that other cellular reprogramming agents, such as WUS or the *Zea mays* LEC1 transcription factor1 gene (LEC1; SEQ ID NOS: 124, SEQ ID 125) can be used, including designs of multigenic expression cassettes using a polycistronic linker ("T2A"; SEQ ID NO: 101 encoding SEQ ID NO: 102). Further, it is expected that the above combinations may also be used with an embryogenesis factor disclosed in Table 6.

Example 13: Methods for Obtaining a Genome-Modified Maternal Doubled Haploid Plant Methods of the present disclosure provide novel haploid inducer lines by transforming a non-haploid inducer line so that it expresses cellular programming agents capable of improving embryogenesis of an unfertilized egg cell to obtain a maternal haploid embryo and by providing gene editing of the maternal haploid embryo. Gene editing components used herein may be regulated in a tissue-specific manner, for example using a promoter active in an egg cell, thereby conferring simultaneous haploid induction and gene editing during gametogenesis. Alternatively, the gene editing components may be constitutively expressed, thereby conferring haploid induction of an embryo with an edited genomic DNA molecule.

In these experiments, plants are obtained from immature embryos transformed with a T-DNA containing three components comprising: 1) a haploid induction component, wherein the plant produces haploid embryos via parthenogenesis; 2) a gene modification component, wherein the obtained haploid embryos have a genome modification such as a gene deletion, substitution, or a gene targeting event via homology directed DNA repair (HDR); and 3) a CRE recombinase component useful for gene excision, wherein the obtained haploid embryos having a genome modification have excision of these gene modification components due to CRE-mediated excision.

A. In Planta Method for Simultaneous Gene Editing of Maternal Haploid Embryos

Figure 7:
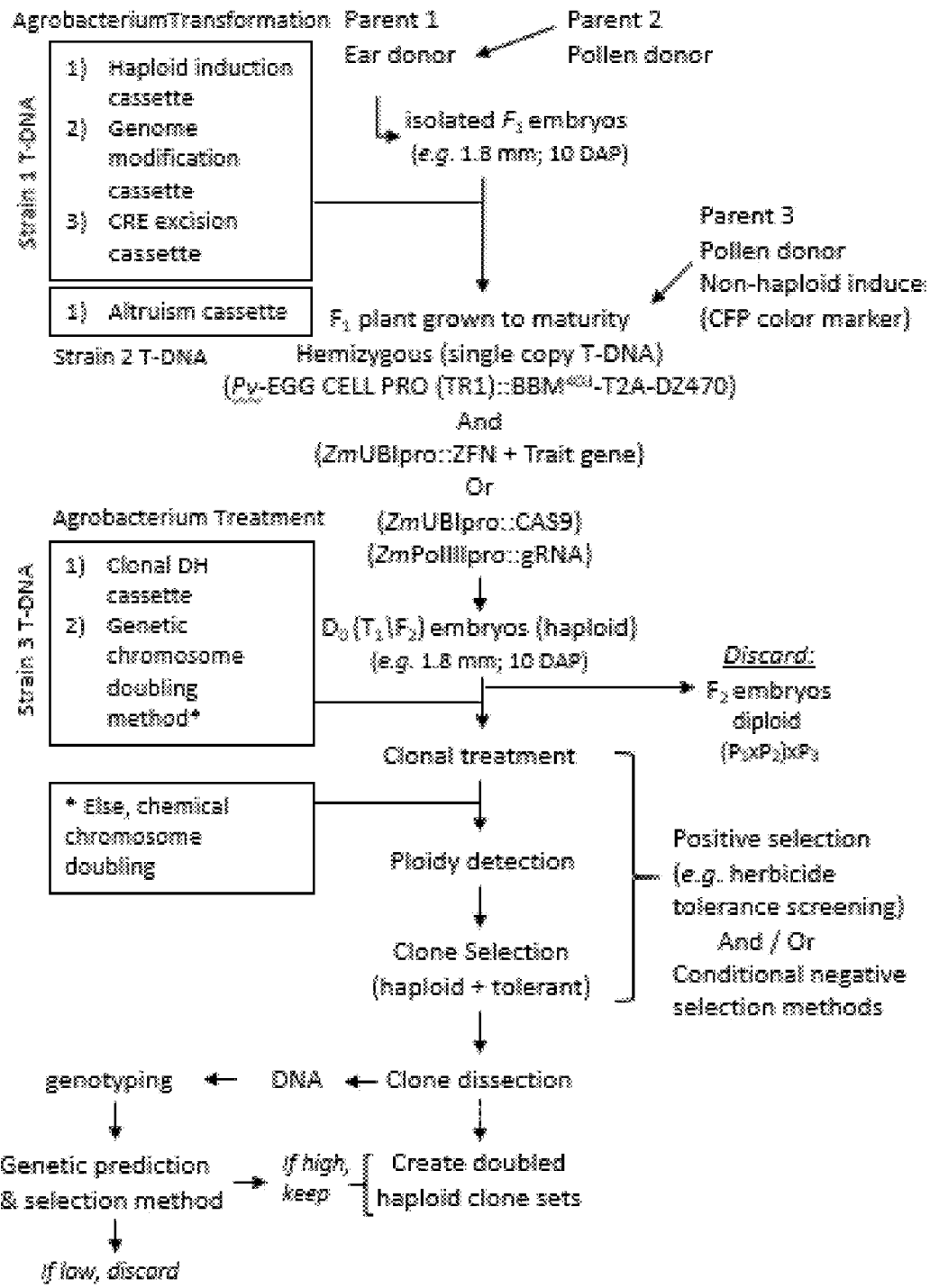
FIG. 7 shows a schematic of simultaneous haploid induction and genome modification using a non-haploid inducer containing a color marker as the pollen donor.
Figure 8A:
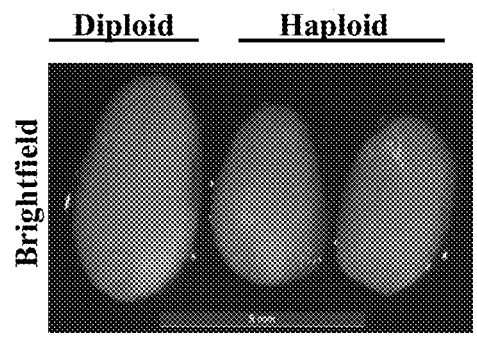
FIG. 8A-FIG. 8F show photo images of diploid and haploid embryos isolated from a haploid induction cross described in FIG. 7 for two (2) independent events.
Figure 8B:
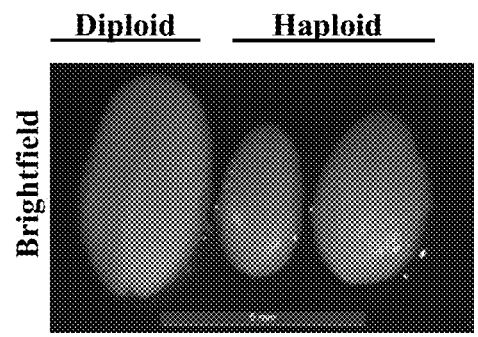
Figure 8C:
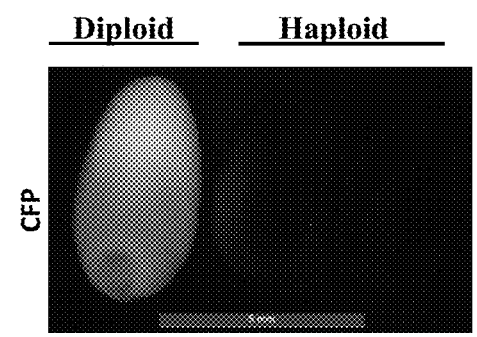
Figure 8D:
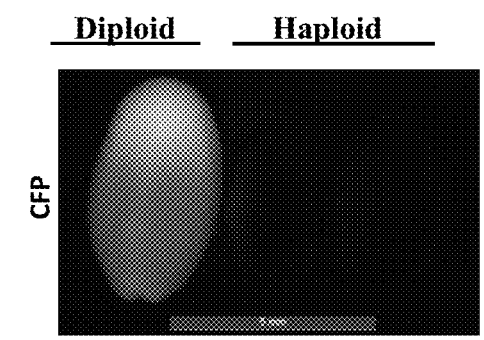
Figure 8E:
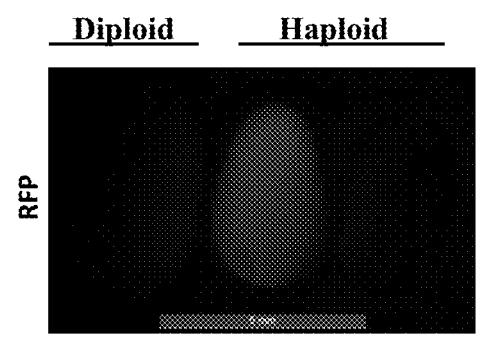
Figure 8F:
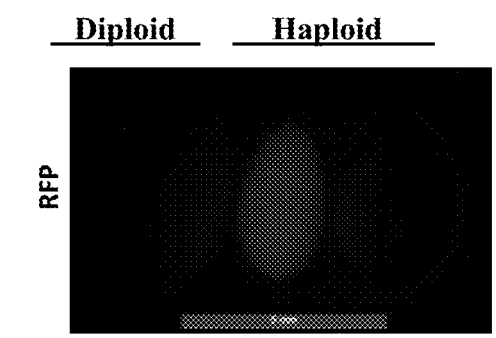

In the current experiment, genome modification was performed using plasmid RV034409 (SEQ ID NO: 400) containing a T-DNA capable of regenerating a $T_0$ plant with i) a haploid induction trait cassette, as described herein using a full length BBM/ODP2 polypeptide ii) a Cas9 gene editing expression cassette containing a DsRED marker gene, and iii) a CRE expression cassette (see FIG. 7). RV034409 contains a polynucleotide expressing a functional Cas9 protein and two gRNAs for cleaving two target sites at ZM-NAC7 (SEQ ID NO: 130). A double-stranded break (DSB) at any one gRNA target site without the addition of foreign DNA is expected, thus it is expected to cause a mutation or small deletion, called an SDN-1 method. It is also expected that double strand breaks by the Cas9 protein at two gRNA target sites can occur causing subsequent DNA repair, for example non-homologous end joining, that exemplifies a two-gRNA "drop-out", called an SDN-2 method.

For breeding purposes, it may be necessary to remove certain trait activities to maintain optimal agronomic performance, such as removing haploid induction and/or genome modification expression cassettes in a doubled haploid line that will be used for breeding purposes. The CRE/lox system was used to excise expression cassettes flanked by loxP sites (SEQ ID NO: 147). This method allows for expression from the haploid induction and genome modification expression cassettes, thereby conferring simultaneous maternal haploid embryo induction and genome modification with CRE recombinase-mediated excision. The CRE recombinase was operably linked to a tissue-preferred promoter (PV-EGG CELL PRO (TR1)).

To recover high-quality $T_0$ plants with an integrated T-DNA conferring simultaneous haploid induction, genome modification, and CRE-mediated excision capabilities, immature embryos of a maize $F_1$ hybrid resulting from the cross of two inbred parental lines (see FIG. 7) were transformed using *Agrobacterium* strain LBA4404 THY- using standard methods.

Transformation was performed using an *Agrobacterium* mixture. In this experiment, a mixture was used comprising (v/v) 90% *Agrobacterium* strain "RV034409" containing a haploid inducer expression cassette, a genome modification expression cassette, and a CRE excision cassette and 10% "RV020636" containing a morphogenic gene expression cassette. The *Agrobacterium* strain having plasmid RV020636 was used to obtain transgenic plants with a single-copy of an integrated T-DNA from plasmid RV034409 with few, if any plants, having a T-DNA from plasmid RV020636. Alternatively, plasmid PHP87078 can be used in place of RV020636.

Following co-infection of each embryo, somatic embryogenesis was activated in response to RV020636 activity and somatic embryos were cultured as described above with the inclusion of a chromosome doubling step. After approximately 6-10 days any proliferating tissue and somatic embryos were dissected and sub-cultured, wherein each portion of dissected tissue was transferred to maturation medium (289Q) for in vitro culture at 26-28° C. under dark conditions. After approximately 6-10 days the sub-cultured tissues were transferred to a light culture room at 26° C. until healthy plantlets with good roots developed. Approximately 7-14 days later, plantlets were transferred to flats containing potting soil and grown for 1 week in a growth chamber, subsequently grown an additional 1-2 weeks in the greenhouse, and then transplanted to soil in pots and grown under greenhouse conditions.

To identify $T_0$ plants containing the desired haploid induction/genome modification/CRE expression cassettes and no RV020636 plasmid sequence, leaf tissue was sampled per plant and evaluated using PCR diagnostic methods. All plants were observed to lack any RV020636 plasmid sequence and single copy RV034409 events were selected.

Selected $T_0$ plants were grown to maturity and were used as ear donors that were fertilized with pollen from a maize inbred that is a non-haploid inducer having a (CFP) marker gene. Other non-haploid inducer lines expressing other marker genes, such as GUS, PMI, PAT, GFP, CFP, B1, C1, R-nj, and/or genes providing anthocyanin pigment activity can also be used. The non-haploid inducer maize inbred may also have a wildtype patatin-like phospholipase A2 gene.

Haploid embryos were scored based on the absence of the CFP marker gene from the paternal parent, CFP-negative embryos, to measure maternal haploid induction in response to parthenogenic gene activity provided to the unfertilized egg cell by the RV034409 T-DNA.

A total of 2163 rescued embryos were sampled from 11 independent events and 134 embryos were CFP-negative, indicating a 6.2% haploid induction frequency (see FIG. 8). Of the 134 embryos, 86 total plants were obtained with 56 of these plants were scored DsRED-negative, indicating that nearly two-thirds of the obtained plants had successful CRE-mediated excision of the RV034409 T-DNA.

DNA from these 56 plants was isolated, sequenced, and analyzed at the NAC7 target site using standard methods. Of the 56 haploid plants that were both CFP-negative and DsRED-negative, 37 plants had NAC7 target site mutations. Thus, relative to the 86 obtained doubled haploid plants, these results demonstrated that 43% of the obtained DH populations had the desired targeted genome modifications.

Such plants will be self-fertilized and are expected to produce progeny that lack the haploid induction/genome modification/CRE-expression traits. The progeny will be examined to evaluate germline inheritance of mutations at the NAC7 target site.

It is expected that further improvements to these haploid induction levels can be achieved using an embryogenesis factor co-expressed with a morphogenic developmental gene. It is also expected that combinations of cellular reprogramming agents disclosed herein will further increase haploid induction.

The results shown here provide improved ability and agility to create specific mutations in specific DH breeding populations in a relatively short period of time and with the utilization of minimal resources.

It is expected that the methods of the present disclosure can be performed using a polynucleotide encoding other nucleases. It is expected that design choices comprising methods using a site-directed nuclease selected from the group consisting of meganucleases (MNs), zinc-finger nucleases (ZFN), transcription-activator like effector nucleases (TALENs), Cas9 nuclease, Cpf1 nuclease, dCas9-FokI, dCpf1-FokI, chimeric Cas9-cytidine deaminase, chimeric Cas9 adenine deaminase, chimeric FEN1-Fok1, Mega-TALs, a nickase Cas9 (nCas9), chimeric dCas9 non-FokI nuclease, dCpf1-non-FokI nuclease, and novel CRISPR-Cas-alpha (a) endonucleases systems will be suitable for use in the methods of the disclosure.

For example, it is expected that a method for inserting a donor template into a double strand break (DSB) target site using homology-directed repair (HDR) can be used in the methods of the present disclosure. An SDN-3 method exemplifies gene targeting and is a DSB at a target site in the genomic DNA accompanied by a template containing a gene or other sequence of genetic material that is transferred into the DSB target site and repaired using the cell's natural repair process.

It is expected that gene targeting methods will be useful in the methods of the present disclosure. The present disclosure describes two expression cassettes for gene targeting, the first using a zinc finger nuclease (ZFN) with a "trait" DNA, in this example the aryloxyalkanoate dioxygenase 1 (AAD-1) gene for conferring 2,4-D herbicide tolerance upon homologous recombination into an intergenic genomic target and the second using a Cas9-mediated gene targeting approach to obtain a plant having the neomycin phosphotransferase II (nptII) selectable marker gene.

It is expected that a ZFN-mediated SDN-3 method will be useful in the methods of the present disclosure. For the ZFN-mediated SDN-3 method, the DSB target site is "Event 32". Features for the ZFN-mediated SDN3 expression cassette (SEQ ID NO: 131) comprises a T-DNA with the first expression cassette containing a polynucleotide encoding an enhanced zinc finger nuclease with E32 target site specificity (E32 eZFN) operably linked to either an embryo-specific promoter the ZmEC promoter (SEQ ID: 405) or a constitutive promoter the Zm Ubiquitin promoter ("ZmUBI PRO", SEQ ID NO: 131). The second expression cassette contains a polynucleotide encoding the aryloxyalkanoate dioxygenase 1 (AAD-1) protein operably linked to a constitutive promoter (ZmUBI PRO) flanked by E32 homology arms flanked by DNA recognition sequences that are E32 eZFN target cut sites, wherein this cassette is disrupting a Zea mays B-Peru (ZmB-Peru) anthocyanin biosynthesis gene operably linked to the Zea mays Globulin-1 (ZmGlob1) promoter (ZmUBI PRO::ZmB-Peru::AtuNOS 3'UTR). Upon excision of the donor template (/ZmUBI PRO::AAD-1::ZmLIP 3' UTR/) by E32 eZFN activity, ZmB-Peru anthocyanin biosynthesis will occur resulting in a visual morphological color marker in cells where the donor template is excised. E32 eZFN activity resulting in a double strand break at the genomic E32 target site followed by homologous recombination of the ZmUBI PRO::AAD-1::ZmLIP 3' UTR via homology directed repair will confer 2,4-D herbicide tolerance, a trait useful for evaluating gene targeting frequencies using positive selection in vitro.

For the Cas9-mediated SDN-3 method, the PHP97131 plasmid (SEQ ID NO: 132) was used containing the following: a haploid induction expression cassette with a polynucleotide encoding a full-length BBM/ODP2 protein operably linked to the PV-EGG CELL PRO (TR1) promoter; a SV40 NLS-Cas9-VIRD2 fusion protein operably linked to a ZM-EXP31554 promoter; gRNA expression cassettes operably linked to Zea mays RNA polymerase III promoter sequences required for creating double strand breaks a Zea mays chromosome 1 target sites; a DsRED fluorescent protein operably linked a constitutive promoter; a maize-optimized CRE recombinase protein operably linked to the PV-EGG CELL PRO (TR1) promoter; and a gene targeting donor template with a polynucleotide encoding the neomycin phosphotransferase II (nptII) selectable marker gene operably linked to a constitutive promoter (ZmUBI PRO) flanked by homology arms. LoxP sites flank the above expression cassettes to allow CRE-mediated excision of the intervening polynucleotide.

In the current experiment, Cas9 activity was expected to result in a double strand break at the chromosome 1 target sites followed by homologous recombination of the ZmUBI PRO::NPT:PIN II terminator via homology directed repair, thereby conferring kanamycin tolerance. DsRED expression, or the absence thereof, was used to evaluate CRE-mediated excision frequencies. Positive selection for kanamycin in vitro can be performed to evaluate gene targeting frequencies.

Immature embryos were transformed as described above. Briefly, immature embryos of a maize $F_1$ hybrid resulting from the cross of two inbred parental lines (see FIG. 7) were transformed using Agrobacterium strain LBA4404 THY-. Transformation was performed using an Agrobacterium mixture. In this experiment, a mixture was used comprising (v/v) 90% Agrobacterium strain "PHP97131" containing a haploid inducer expression cassette, a genome modification expression cassette, and a CRE excision cassette and 10% "RV020636" containing a morphogenic gene expression cassette. The Agrobacterium strain having plasmid RV020636 was used to obtain transgenic plants with a single-copy of an integrated T-DNA from plasmid PHP97131 with few, if any plants, having a T-DNA from plasmid RV020636. Alternatively, plasmid PHP87078 can be used in place of RV020636.

More than 240 $T_0$ plants with a single copy of a T-DNA from plasmid PHP97131 conferring simultaneous haploid induction, genome modification, and CRE-mediated excision capabilities were grown to maturity. The $F_1/T_0$ plants used as ear donors (female parent) were fertilized with pollen from a maize inbred different from the two $F_1$ hybrid parents, specifically a non-haploid inducer line containing a CFP color marker. Approximately 14-18 days after fertilization, donor ears containing immature embryos were harvested and immature embryos were collected and scored. CFP-negative embryos were maternal haploid embryos given the absence of the paternal CFP color marker. CFP-negative embryos that were also DsRED-negative had egg cell expression of the genome-modification expression cassettes. These CFP-negative/DsRED-negative embryos were selected, cultured, and regenerated plantlets were transplanted to soil.

Leaf material was sampled for DNA isolation that was used for molecular analysis using standard methods. Diagnostic assays to PCR amplify across the junction sites to measure HDR-mediated gene insertion of the donor template were performed.

These results indicated that 4 of 240 plants had evidence of HDR-mediated repair for at least one of the two flanking junction sites indicating evidence of integration of the excised donor template at the DSB target site. DNA of these 4 plants was selected for further next generation sequencing efforts to further characterize the composition of the T-DNA that was integrated into the DSB site. It is expected that progeny will be obtained from such plants that will inherit a stably integrated gene targeting event, wherein the T-DNA encoding a trait gene has been integrated into the desired genomic target site.

As shown above, the methods of the present disclosure provide maternal haploid plants possessing a gene edit. It is expected that any of the embryogenesis factors described in Table 6 can be used to further improve haploid induction/gene editing levels.

B. In Vitro Method for Clonal Propagation of a Genome Modified Haploid Embryo

Once grown to maturity, a $F_1/T_0$ plant used as an ear donor is fertilized with pollen from a wildtype, non-haploid inducing, CFP-positive paternal inbred, clonal plants can be obtained from the treated haploid embryos, wherein the methods of the present disclosure provide propagation of a clonal plant derived from a genome-modified haploid embryo.

For example, approximately 9-14 days after pollination, donor ears are harvested with haploid embryos preferably ranging in size from 1.7 mm to 1.9 mm. the isolated embryos can be treated using an *Agrobacterium* containing the plasmid RV020636. This plasmid has a "3XENH-3XEME-WUS" expression cassette (FMV ENH:PSCV ENH:MMV ENH:ZM-(3XEMEs)-PLTP PRO::ZM-WUS2::IN2-1 TERM; SEQ ID NO: 134). A clonal plant is obtained using a method comprising providing to a first plant cell a morphogenic gene expression cassette; eliciting a growth response in a second plant cell, wherein the second plant cell does not contain the morphogenic gene expression cassette; and regenerating the clonal plant from the second plant cell. Typically, it is expected that the clonal doubled haploids will be lacking a polynucleotide from plasmid RV020636. It is expected that such embryogenic activity can be provided to a second cell wherein the plasmid RV020636 is provided to a first cell using other standard methods, for example using biolistic particle bombardment. It is also expected that other plasmids can be used, for example the PHP87078 plasmid (SEQ ID: 133).

It is expected that haploid embryos are identified based on the absence of visible CFP expression (CFP-positive embryos are discarded). Putative genome-modified embryos are DsRED-negative and can be expected to produce progeny lacking haploid induction/genome modification/CRE-expressing traits. Haploid embryos (CFP-negative/DsRED-negative) that produce 1 or more somatic embryos can be dissected and sub-cultured. Before, during, or after the dissection step, explant tissues derived from a treated haploid cell can be exposed to a chemical chromosome doubling agent, such as those listed in Table 2 using standard methods, to obtain clonal doubled haploid plants.

C. Selecting Individuals Using Predictions

Standard methods of genomic selection estimate effects of genome-wide molecular markers to calculate genomic estimated breeding values (GEBVs) for individuals without phenotypes. For example, GEBV can be used as a selection criterion by predicting phenotypic performance with canonical methods computing predictions using genetic marker data that measure allelic states at genome-wide loci. Methods for creating genetic marker data are known and by sampling a tissue per DH line, isolating DNA per tissue sample, and genotyping each sample, it is possible to determine allelic inheritance patterns at genome-wide loci for computing a GEBV per DH line.

As an exemplary method of the present disclosure, it is expected that when plasmid RV034409 (SEQ ID NO: 401) is stably transformed into an immature hybrid embryo as described above and $T_0$ plants are obtained, each plant is considered a unique, independent event. These plants are used as female ear donors, wherein the male pollen donor is a non-haploid inducer line containing a CFP color marker (CFP-positive). Following pollination, each donor ear is harvested approximately 10 days post-fertilization and embryos are rescued using standard methods. Optionally, the rescued embryos can be used for the in vitro clonal propagation treatment described above. After harvesting, the embryos are scored for the presence/absence of CFP expression and CFP-negative embryos are scored as maternal haploid embryos resulting from parthenogenesis conferred by the haploid induction expression cassette of plasmid RV034409 (SEQ ID NO: 401). Embryos are also scored for the presence/absence of DsRED expression and DsRED-negative embryos are considered to be events whereby CRE-mediated excision had occurred. These CFP-negative/DsRED-negative embryos can be further analyzed for evidence of targeted genome modification. Plant tissue can be sampled, DNA isolated, and genotyped to enable marker assisted selection and/or predictive selection using standard methods.

The methods of the present disclosure, when combined with selection using prediction provide a unique suite of technologies to plant breeding programs that facilitate creating novel genetic diversity in a relatively short time, with capabilities to perform a predictive selection for each created $D_0$ line that can also have a desired genome modification, thus enabling a method for obtaining an enriched population of genome-modified maternal doubled haploid plants. It is expected the methods disclosed herein will favorably impact the rate of genetic gain in a breeding program.

Example 14: Method Improving Maize Maternal Doubled Haploid Productivity Using Degenerate Cas9 Technologies The methods of the present disclosure describe obtaining a transgenic haploid plant by introducing an expression cassette into a plant genome expressing a heterologous protein that binds to a target locus in a plant cell, wherein the heterologous protein comprises a deactivated Cas9 (dCas9) translational fusion polypeptide. The method is used to recruit the deactivated Cas9 (dCas9) translational fusion polypeptide to a target locus in the plant genome wherein the locus encodes a morphogenic developmental gene or an embryogenesis factor, or by recruiting deactivated Cas9 (dCas9) translational fusion polypeptides to any combination of targets thereof.

The methods of the present disclosure include designs for heterologous proteins comprising a degenerate, also known as deactivated Cas9 protein (dCas9) fused to a chromatin modification domain. The dCas9-fusion protein is recruited to a target locus encoding an embryogenesis factor and/or morphogenic developmental gene using guide RNAs (gRNAs). Once the ribonucleotide complex is recruited to the target locus, cellular reprogramming is achieved by altering post-translational modifications of histone modifications, including (a) removing histone modifications associated with repressing gene expression, (b) establishing histone modifications associated with promoting gene expression, and/or (c) recruiting transcriptional machinery associated with expressing the target locus.

The methods described herein provide dCas9 technologies useful in paternal doubled haploid methods. In these experiments, such methods of the present disclosure are applicable to cellular reprogramming activity in an unfertilized egg cell by activating parthenogenesis in a haploid egg cell resulting in the production of maternal doubled haploids.

For example, the dCas9 translational fusion proteins in Table 9 are useful in the methods of the present disclosure for combining protein activities of any of the various heterologous proteins comprising SEQ ID NOS: 78 to 82 in an egg cell to promote parthenogenesis which is the growth and development of a maternal embryo that occurs without fertilization. For proper endosperm development, it is expected that fertilization can be required, but the embryo is not. Therefore, present disclosure provides a method of pseudogamy in which this maternal haploid induction method requires pollination but does not involve male inheritance.

As stated above, exemplary sequences of chromatin modifying domains are shown in Table 8 and 9, when those polynucleotides are operably linked to a *Zea mays* UBIQUITIN promoter they are expressed in a non-tissue specific manner. For the methods of present disclosure, wherein it is desired to express the heterologous proteins in or near an egg cell during megagametogenesis, the methods disclosed herein can use egg cell-preferred, or ideally, egg cell-specific promoters. It is expected that using an *Agrobacterium* with a plasmid containing a T-DNA with such multiple expression cassettes encoding multiple dCas9 translational fusions can require using multiple egg cell promoters. For this reason, exemplary polynucleotide sequences are provided in Table 12 using three different egg cell promoters for the exemplary dCas9 translational fusion proteins.

TABLE 12 dCas9 translational fusion proteins useful for in planta haploid induction

| Expression Cassette Name | Feature Elements | DNA SEQ ID NO: | Peptide SEQ ID NO: |
|---|---|---|---|
| TaEC PRO::dCas9-CBF1A | TA-EC PRO::UBI1ZM 5UTR::UBI1ZM::SV40 NLS::CAS9 EXON1 (SP) (MO)::ST-LS1 INTRON2::CAS9 EXON2 (SP) (MO)::VIRD2NLS (TR2)::30XQ-V2::AT-CBF1A (MO1) (TR1)::PINII TERM | 148 | 402 |
| TaEC PRO::dCas9-GNAT1 | TA-EC PRO::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-GNAT1-V1::PINII TERM | 149 | 78 |
| TaEC PRO::dCas9-GNAT2 | TA-EC PRO::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-GNAT2-V1::PINII TERM | 150 | 79 |
| TaEC PRO::dCas9-HAT1 | TA-EC PRO::UBI1ZM 5UTR::UBI1ZM::SV40 NLS: :CAS9 EXON1 (SP) (MO)::ST-LS1 INTRON2::CAS9 EXON2 (SP) (MO)::VIRD2 NLS (TR2)::30XQ-V2::ZM-HAT1-V1::PINII TERM | 151 | 80 |
| TaEC PRO::dCas9-HAT2 | TA-EC PRO::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-HAT2-V1::PINII TERM | 152 | 81 |
| TaEC PRO::dCAS9-jmj | TA-EC PRO::UBI1ZM 5UTR::UBI1ZM INTRON1::SV40 NLS::ZM-JMJN::GLY4SER LINKER::ZM-JMJN::GLY4SER LINKER::CAS9 EXON1 (SP) (MO) (MOD1) (TR1)::ST-LS1 INTRON2::CAS9 EXON2 (SP) (MO) (ALT1)::GLY4SER LINKER::ZM-JMJC (TR1)::VIRD2 NLS::PINII TERM | 153 | 82 |
| ZmEC1 PRO-V3::dCas9-CBF1A | ZM-EGG PRO-V3::UBI1ZM 5UTR::UBI1ZM::SV40 NLS::CAS9 EXON1 (SP) (MO)::ST-LS1 | 154 | 402 |

TABLE 12-continued dCas9 translational fusion proteins useful for in planta haploid induction

| Expression Cassette Name | Feature Elements | DNA SEQ ID NO: | Peptide SEQ ID NO: |
|---|---|---|---|
| ZmEC1 PRO-V3::dCas9-GNAT1 | ZM-EGG PRO-V3::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::AT-CBF1A (MO1) (TR1)::PINII TERM ZM-EGG PRO-V3::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-GNAT1-V1::PINII TERM | 155 | 78 |
| ZmEC1 PRO-V3::dCas9-GNAT2 | ZM-EGG PRO-V3::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-GNAT2-V1::PINII TERM | 156 | 79 |
| ZmEC1 PRO-V3::dCas9-HAT1 | ZM-EGG PRO-V3::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-HAT1-V1::PINII TERM | 157 | 80 |
| ZmEC1 PRO-V3::dCas9-HAT2 | ZM-EGG PRO-V3::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-HAT2-V1::PINII TERM | 158 | 81 |
| ZmEC1 PRO-V3::dCAS9-jmj | ZM-EGG PRO-V3::UBI1ZM 5UTR::UBI1ZM INTRON1::SV40 NLS::ZM-JMJN::GLY4SER LINKER::ZM-JMJN::GLY4SER LINKER::CAS9 EXON1 (SP) (MO) (MOD1) (TR1)::ST-LS1 INTRON2::CAS9 EXON2 (SP) (MO) (ALT1)::GLY4SER LINKER::ZM-JMJC (TR1)::VIRD2 NLS::PINII TERM | 159 | 82 |
| ZM-GLB PRO::dCas9-CBF1A | ZM-GLB PRO::UBI1ZM 5UTR::UBI1ZM::SV40NLS::CAS9 EXON1 (SP) (MO)::ST-LS1 INTRON2::CAS9 EXON2 (SP) (MO)::VIRD2 NLS (TR2)::30XQ-V2::AT-CBF1A (MO1) (TR1)::PINII TERM | 160 | 402 |
| ZM-GLB PRO::dCas9-GNAT1 | ZM-GLB PRO::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-GNAT1-V1::PINII TERM | 161 | 78 |
| ZM-GLB PRO::dCas9-GNAT2 | ZM-GLB PRO::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-GNAT2-V1::PINII TERM | 162 | 79 |
| ZM-GLB PRO::dCas9-HAT1 | ZM-GLB PRO::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-HAT1-V1::PINII TERM | 163 | 80 |
| ZM-GLB PRO::dCas9-HAT2 | ZM-GLB PRO::UBI1ZM 5UTR::UBI1ZM::SV40 NLS::CAS9 EXON1 (SP) (MO)::ST-LS1 INTRON2::CAS9 EXON2 (SP) (MO)::VIRD2 NLS (TR2)::30XQ-V2::ZM-HAT2-V1::PINII TERM | 164 | 81 |

TABLE 12-continued dCas9 translational fusion proteins useful for in planta haploid induction

| Expression Cassette Name | Feature Elements | DNA SEQ ID NO: | Peptide SEQ ID NO: |
|---|---|---|---|
| ZM-GLB PRO::dCAS9-jmj | ZM-GLB PRO::UBI1ZM 5UTR::UBI1ZM INTRON1::SV40 NLS::ZM-JMJN::GLY4SER LINKER::ZM-JMJN::GLY4SER LINKER::CAS9 EXON1 (SP) (MO) (MOD1) (TR1)::ST-LS1 INTRON2::CAS9 EXON2 (SP) (MO) (ALT1)::GLY4SER LINKER::ZM-JMJC (TR1)::VIRD2 NLS::PINII TERM | 165 | 82 |

In addition, a multigenic expression cassette can be used in the methods of the present disclosure and is designed using known methods. For example using a polycistronic linker ("T2A"; SEQ ID NO: 101 encoding SEQ ID NO: 102) as previously described between each polynucleotide encoding each desired dCas9 translational fusion protein to be expressed can allow multigenic expression, wherein the expression cassette is operably linked to a particular egg cell promoter.

To exemplify the cellular reprogramming methods of the present disclosure, six different constructs were created. Two different fusion proteins were used, here called "dCas9-CBF1A" and dCas9-HAT2" with the deactivated Cas9 domain fused to the CBF1a domain or the HAT2 domain, respectively. For each fusion protein, variant plasmids having a differing number of gRNA targets were designed to evaluate haploid induction in response to egg cell activity of these dCas9 translational fusion proteins to activate the given genomic target sites.

In a first plasmid the dCas9-CBF1A protein was designed to target the ODP2 genomic target site using plasmid PHP97202 (see Table 4; SEQ ID: 410). In a second plasmid the dCas9-CBF1A protein was designed to target the ODP2, WUS2, and LEC1 genomic target site using plasmid PHP97330 (see Table 4; SEQ ID: 411). In a third plasmid the dCas9-CBF1A protein was designed to target the ODP2, WUS2, LEC1, and CYCD2 (see Table 6, embryogenesis factor 5, dpzm07g031470.1.1) genomic target site using plasmid PHP97566 (see Table 4; SEQ ID: 412). In a fourth plasmid the dCas9-HAT2 protein was designed to target the ODP2 genomic target site using plasmid PHP97203 (see Table 4; SEQ ID: 413). In a fifth plasmid the dCas9-HAT2 protein was designed to target the ODP2, WUS2, and LEC1 genomic target site using plasmid PHP97388 (see Table 4; SEQ ID: 414). In a sixth plasmid the dCas9-HAT2 protein was designed to target the ODP2, WUS2, LEC1, and CYCD2 (see Table 6, embryogenesis factor 5, dpzm07g031470.1.1) genomic target site using plasmid PHP97331 (see Table 4; SEQ ID: 415). Plasmids having a 2 or more gRNA were designed with a polynucleotide encoding the endoribonuclease Csy4 (Cas6f) and a precursor RNA. crRNA biogenesis was performed by designing the precursor RNA to contain a spacer with motifs allowing the precursor RNA to be enzymatically cleaved, thereby generating mature CRISPR-derived RNAs (crRNAs) enabling simultaneous targeting of 1 or more target sites.

It is understood that regions of interest for gRNA binding to such loci include but are not limited to proximal promoter regions, for example ranging up to ten kilobases upstream of the transcription start site (TSS), typically with at least one gRNA targeting a region per endogenous locus. Methods using a gRNA binding to a distal cis regulatory element can also be used, with at least one gRNA targeting a cis regulatory element.

In these experiments, each plasmid was used for plant transformation using the methods disclosed herein. In these plant breeding experiments immature $F_1$ embryos were transformed to obtain $D_0$ haploid plants derived from a biparental cross as described herein. Alternatively, an embryo can be transformed from any other biparental crosses such as an embryo from a backcross.

After *Agrobacterium*-mediated transformation, somatic embryo maturation and regeneration, $T_0$ plants were analyzed by qPCR to identify single copy, hemizygous individuals containing the desired T-DNA. Such plants were grown and will be used as ear donor (female) plants, with the donor ear pollinated with viable pollen grains collected from the anthers of the male non-haploid inducer parent plants constitutively expressing a cyan fluorescent protein (CFP) color marker. Maternal haploid embryos are identified by isolating the embryos from donor ears approximately 9-18 days after pollination.

Maternal haploid embryos develop in response to cellular reprogramming activity conferred by the dCas9 translational fusion/gRNA expression cassettes. From a plant breeding perspective, these embryos are the initial haploid generation that upon doubling will become first generation doubled haploids, also called "$D_0$" plants.

It is expected that activity of the dCas9 translational fusion protein/gRNA complex recruited to an endogenous locus in an egg cell will reprogram the egg cell fate, activate parthenogenesis, and allow growth and development of a maternal embryo in the absence of fertilization. It is expected haploid induction levels in response to a plasmid activating the ODP2, WUS2, LEC1, and CYCD2 (e.g. PHP97566, PHP97331) will exceed the haploid induction level of a plasmid activating the ODP2, WUS2, and LEC1 (e.g. PHP97330, PHP97388). Moreover, it is expected that the four plasmids (e.g. PHP97566, PHP97331, PHP97330, PHP97388) will exceed the haploid induction level of a plasmid activating ODP2 alone (e.g. PHP97202, PHP97203).

A method of chromosome doubling for a maternal haploid plant can be performed, for example by transferring the haploid embryo to a medium with a chromosome doubling (or mitotic inhibitor) agent to create a doubled haploid plant. For example, colchicine concentrations of 0.1-1.0 g/ml to cause mitotic arrest of dividing cells at metaphase by interfering with microtubule organization or any of the chromosome doubling agents such as those listed in Table 2 using standard methods.

Together, these methods provide advancements for plant breeding methods, particularly for methods of propagating a maternal haploid plant from an unfertilized egg cell, in which manipulation of gene regulation at an endogenous locus is altered to improve cellular reprogramming.

It is expected that improved cellular reprogramming methods in a gamete cell, more specifically a female gamete cell as described herein, can be used to improve maize maternal doubled haloid production. It is expected that the methods disclosed herein can be used in other crop and vegetable breeding systems.

The methods disclosed herein provide improvements in maternal doubled haploid production. For example, the method for expressing a dCas9 translation fusion protein operably linked to an egg cell promoter that can simultaneously activate a multitude of loci to reprogram the activity in an unfertilized egg and activate parthenogenesis in a haploid egg cell is a significant improvement in maternal doubled haploid production. It is expected that loci of interest comprise designs of gRNA molecules for binding to loci encoding the novel embryogenesis factors described in Table 6 and/or loci encoding morphogenic genes.

The methods of the present disclosure provide improvements in the identification and selection of maternal haploid embryos in that the fertilization required for proper endosperm development introduces a color marker from a non-haploid inducer, thereby allowing the identification and selection of maternal haploid embryos.

The present disclosure provides a method to regulate a target locus in an egg cell using dCas9 translational fusion proteins containing chromatin modifying domains, for example using the expression cassettes shown in Table 12. It is expected that target gene activation to induce parthenogenesis will be improved in response to the activity of dCas9 translational fusion proteins containing chromatin modifying domains, whereby histone modifications at a target site locus can be post-translationally modified with histone modifications correlated with active, euchromatin chromatin states. As a result, it is expected that this mode of action can promote improved cellular reprogramming activity in comparison to transcriptional activation alone. It is expected that co-expression of a dCas9 translational fusion protein containing chromatin modifying domain and a dCas9 translational fusion protein containing a transcriptional activator domain, such as the dCas9-CBF1A fusion protein, can further improve cellular reprogramming in a treated cell when those components are active together.

It is expected that a combinatorial use of dCas9 translational fusion proteins capable of binding to a multitude of loci encoding genes with activity that promote parthenogenesis improves haploid induction methods in an increasingly genotype-independent manner. These methods provide improvements in plant breeding methods, particularly methods of propagating a maternal haploid plant from an unfertilized egg cell, in which manipulation of gene regulation at an endogenous locus is altered to improve cellular reprogramming.

Example 15: Method for Improving Maternal Haploid Induction Using Endosperm-Mediated Cellular Reprogramming The methods of the present disclosure provide improved maternal haploid plant production technologies using endosperm-mediated cellular reprogramming.

Representative examples of cellular reprogramming agents are shown in Table 13. Cellular reprogramming agents useful in the methods of the disclosure include but are not limited to polynucleotides comprising the ZM-BETL9 SSP fused to an embryogenesis factor, such as the embryogenesis factors described in Table 6 and/or to a morphogenic developmental gene, such as WUS, BBM or LEC1. Maternal haploid induction using endosperm-mediated cellular reprogramming is improved by expressing combinations of these translational fusion proteins from a T-DNA integrated into the genome of the male parent. These multigenic expression cassettes use the a polycistronic linker ("T2A"; SEQ ID NO: 101 encoding SEQ ID NO: 102) between the coding sequence of each desired protein as shown in Table 13. For the multigenic expression cassettes of the present disclosure, the combinations of each expressed protein are provided.

TABLE 13

Expression cassettes useful for endosperm-mediated cellular reprogramming technology

| Name | Description | DNA SEQ ID NO: | Protein SEQ ID NO: |
|---|---|---|---|
| ZM-BETL9 PRO | Zea mays Basal Endosperm Transfer Layer 9 promoter + 5' UTRsequence | 348 | na |
| ZM-BETL9SP | Zea mays Basal Endosperm Transfer Layer 9 secretion signal peptide (SSP) | 346 | 347 |
| ZM-BETL9-like PRO | Zea mays Basal Endosperm Transfer Layer9-like promoter + 5' UTRsequence | 351 | na |
| ZM-BETL9-likeSP | Zea mays Basal Endosperm Transfer Layer9-like secretion signal peptide (SSP) | 349 | 350 |
| SSP-BBM$^{403}$(Var2) | SSP-BBM$^{403}$(Var2) | 170 | 189 |
| SSP-BBM$^{402}$ | SSP-BBM$^{402}$ | 171 | 190 |
| SSP-DZ470(TR3) | SSP-DZ470(TR3) | 172 | 191 |
| SSP-DZ470(TR4) | SSP-DZ470(TR4) | 173 | 192 |
| SSP-CDKA1 | SSP-CDKA1 | 174 | 193 |
| SSP-CDKA3 | SSP-CDKA3 | 175 | 194 |
| SSP-WUS2 | SSP-WUS2 | 176 | 195 |
| SSP-WUS2(TR2) | SSP-WUS2(TR2) | 177 | 196 |
| BBM$^{403}$(Var2) | BETL9pro::BETL 5UTR + SSP-BBM$^{403}$(Var2) + PINII TERM | 178 | 189 |

TABLE 13-continued

Expression cassettes useful for endosperm-mediated cellular reprogramming technology

| Name | Description | DNA SEQ ID NO: | Protein SEQ ID NO: |
|---|---|---|---|
| SSP-BBM$^{402}$ + SSP-Dz470 | BETL9pro::BETL 5UTR + SSP-BBM$^{402}$ + T2A + SSP-DZ470(TR3) + PINII TERM | 179 | 190 and 191 |
| SSP-BBM$^{402}$ + SSP-Dz470 + SSP-CDKA1 | BETL9pro::BETL 5UTR + SSP-BBM$^{402}$ + T2A + SSP-DZ470 (TR4) + T2A + SSP-CDKA1 + PINII TERM | 180 | 190 and 192 and 193 |
| SSP-BBM$^{402}$ + SSP-Dz470 + SSP-CDKA3 | BETL9pro::BETL 5UTR + SSP-BBM$^{402}$ + T2A + SSP-DZ470(TR4) + T2A + SSP-CDKA3 + PINII TERM | 181 | 190 and 192 and 194 |
| SSP-WUS | BETL9pro::BETL 5UTR+ SSP-WUS2 + PINII TERM | 182 | 195 |
| SSP-WUS + SSP-DZ470 | BETL9pro::BETL 5UTR + SSP-WUS2(TR2) + T2A + SSP-DZ470 + PINII TERM | 183 | 196 and 191 |
| SSP-WUS + SSP-DZ470 + SSP-CDKA1 | BETL9pro::BETL 5UTR + SSP-WUS2(TR2) + T2A + SSP-DZ470 (TR) + T2A + SSP-CDKA1 + PINII TERM | 184 | 196 and 192 and 193 |
| SSP-WUS + SSP-DZ470 + SSP-CDKA3 | BETL9pro::BETL 5UTR + SSP-WUS2(TR2) + T2A + SSP-DZ470 (TR) + T2A + SSP-CDKA3 + PINII TERM | 185 | 196 and 192 and 194 |
| SSP-BBM$^{402}$ + SSP-WUS | BETL9pro::BETL 5UTR + SSP-BBM$^{402}$ + T2A + SSP-WUS2(TR2) + PINII TERM | 186 | 190 and 196 |

The expression cassettes disclosed in Table 13 are integrated into a non-haploid inducer expressing a selectable marker, such as CFP as described herein. These non-haploid inducer lines are used as the male parent as described herein. It is expected that these endosperm-mediated cellular reprogramming methods can be combined with the other methods disclosed herein to increase doubled haploid production.

In these experiments, expression cassettes of interest (SEQ ID NOS: 179-186) are transferred into a T-DNA of a plasmid used for transformation as described herein. Such a T-DNA can include a second expression cassette for expressing a selectable marker, such as UBI1ZM PRO+UBI1ZM 5UTR+UBI1ZM INTRON1+DS-RED2+PINII TERM (SEQ ID NO: 99), and a third expression cassette containing a polynucleotide encoding the CRE/lox recombination system flanking an embryogenesis factor expression cassette and/or a morphogenic gene expression cassette including but not limited to the WUS2/ODP2 co-expression cassette (SEQ ID NO: 97), wherein CRE is operably linked to a promoter allowing excision of WUS2/ODP2/CRE cassettes after transformation, thereby allowing regeneration of transgenic plants containing only the first and second expression cassettes.

Alternatively, the second expression cassette useful in these method can be designed to express a genome modification nuclease. For example, an expression cassette can be used for site directed mutagenesis (SDN) using a functional Cas9 nuclease and a guide RNA (UBIZM PRO::CAS9(SP) (MO)+ZM-U6 POLIII::crRNA-tracRNA fusion transcript, SEQ ID NO: 130), wherein the cassette contains a dual guide design targeting the Zea mays genomic sequence "GAAGGGGCTTCGGAGGAT" (ZM-NAC7-CR5) (SEQ ID NO:406) and "GTGATGCATCCGGACGGG" (ZM-NAC7-CR10) (SEQ ID NO:407) at the NAC Transcription Factor 7 (dpzm03g031130) locus. For a Cas9 nuclease acting as a genome modification agent, a translational fusion using N-terminal fusions of the ZM-BETL9 SSP (polypeptide SEQ ID: 347) are used to create heterologous fusion proteins to promote the transfer of the protein from an endosperm cell to an embryo cell.

In the methods of the present disclosure, it is expected that expressing combinations of cellular reprogramming agents and genome modification agents can be performed from a T-DNA integrated into the genome of the male parent. Thus, multigenic expression cassettes using the a polycistronic linker ("T2A"; SEQ ID NO: 101 encoding SEQ ID NO: 102) between the coding sequence of each desired protein can be used. A promoter, for example the Zea mays Basal Endosperm Transfer Layer 9 promoter ("ZM-BETL9 PRO"; SEQ ID NO: 348) can be operably linked to a secretion signal peptide (SSP), for example the Zea mays Basal Endosperm Transfer Layer 9 ("ZM-BETL9 SSP", polynucleotide SEQ ID NO: 346 encoding polypeptide SEQ ID NO: 347) that is fused to each polypeptide comprising the cellular reprogramming agents and the genome modification agents. Any known genome modification nuclease fused to a secretion signal peptides (SSP), for example and the N-terminus of the polypeptide can be used in the methods disclosed herein. Genome modification peptides may comprise a C-terminus fusion to a cell penetrating peptide including not limited to the Z. mays knotted1 CPP (ZM-KNT1 CPP; SEQ ID NO: 48 encoding SEQ ID NO: 49), the Saccharomyces pombe TP10 CPP (SP-TP10 CPP; SEQ ID NO:50 encoding SEQ ID NO: 51), the Candida albicans Zebra CPP (CA-Zebra CPP; SEQ ID NO: 52 encoding SEQ ID NO: 53), the PEP1 CPP (PEP1 CPP; SEQ ID NO: 54 encoding SEQ ID NO: 55), the HIV-1 TAT CPP (HIV-1 TAT CPP; SEQ ID NO: 56 encoding SEQ ID NO: 57), and the gamma-zein cell penetrating peptide (GZ CPP; SEQ ID NO: 58 encoding SEQ ID NO: 59) Such translational fusions exemplify protein properties that (a) can be secreted from a cell expressing the protein, (b) can create a mutation at a target site in the genome of a cell, and (c) can improve protein uptake and/or delivery of the expressed proteins. Methods using nucleases the do not use a guide RNA, for example meganucleases (MNs), zinc-finger nucleases (ZFN), transcription-activator like effector nucleases (TALENs) are useful in the methods disclosed herein.

When using a multigenic expression cassette comprising a polynucleotide encoding combined cellular reprogramming agents and genome modification agents, the third expression cassette is designed to transcribe a guide RNA molecule and comprises in operable linkage the ZmU6 promoter and a guide RNA. Alternatively, other promoters are used in operable linkage with the guide RNA, for example an endosperm-preferred promoter. Further, a synthetic guide RNA molecule, or combination of synthetic guide RNA molecules, can be exogenously delivered using standard methods, including, but not limited to, biolistic delivery, electroporation, or Agrobacterium-mediated delivery into cells with a pre-integrated gene editing trait.

After Agrobacterium-mediated transformation, somatic embryo maturation and regeneration, $T_0$ plants are analyzed by qPCR to identify single copy, hemizygous individuals containing the desired T-DNA. These $T_0$ plants are propagated to obtain a seed stock for use as a pollen donor.

Once a $T_0$ plant is grown to maturity, crossing methods are performed. Briefly, transgenic plants are used as male parent plants, with the donor ear of a second plant, for example an $F_1$ hybrid ($P_1 \times P_2$). Approximately 9-14 days after pollination, the immature ears are harvested, and immature embryos are isolated using standard methods. At this stage, each diploid embryo is resultant of a three-way cross, for example a ($P_1 \times P_2$)$\times P_3$ pedigree, while each maternal haploid embryo is a unique genetic entity with a ($P_1 \times P_2$) pedigree, which is the product of meiosis equivalent to a $F_{1:2}$ maternal gamete.

In the current example, diploid embryos with inheritance of the paternal genome will express a color marker, or possibly express other morphological markers expressed from a paternal gene, such as a biosynthesis gene. Selection of maternal haploid embryos can be performed based on the absence of such paternal gene activity (absence of expression of a color marker). Such a maternal haploid embryo has developed in response to cellular reprogramming activity and/or genome modification activity conferred by the endosperm delivery expression cassette.

From a plant breeding perspective, these embryos are the initial haploid generation that upon doubling will become first generation doubled haploids, also called "$D_0$" plants. Using standard methods, a haploid embryo is expected to germinate and produce one plant. However, productivity losses occur, and such haploid embryos can fail to germinate, thereby resulting in attrition of the population. In these experiments, doubled haploid plant regeneration frequencies are improved.

Specifically, upon isolation, all embryos are transformed with Agrobacterium strain LBA4404 THY- using standard methods. Transformation was performed using an Agrobacterium mixture. In this experiment, a mixture was used comprising (v/v) 90% Agrobacterium strain containing an endosperm-mediated cellular reprogramming haploid inducer expression cassette and/or a genome modification expression cassette, and/or a CRE excision cassette described in this Example 15 and 10% "RV020636" containing a morphogenic gene expression cassette. The Agrobacterium strain having plasmid RV020636 was used to obtain transgenic plants with a single-copy of an integrated T-DNA from the plasmid containing an endosperm-mediated cellular reprogramming haploid inducer expression cassette and/or a genome modification expression cassette, and/or a CRE excision cassette with few, if any plants, having a T-DNA from plasmid RV020636. Alternatively, plasmid PHP87078 can be used in place of RV020636.

Following co-infection of each embryo, somatic embryogenesis was activated in response to RV020636 activity and somatic embryos are cultured as described above with the inclusion of a chromosome doubling step. Haploid embryos are identified based on the absence of visible CFP expression (CFP-positive embryos are discarded). After approximately 6-10 days any proliferating tissue and somatic embryos are dissected and sub-cultured, wherein each portion of dissected tissue is transferred to maturation medium (289Q) for in vitro culture at 26-28° C. under dark conditions. After approximately 6-10 days the sub-cultured tissues are transferred to a light culture room at 26° C. until healthy plantlets with good roots develop. Approximately 7-14 days later, plantlets are transferred to flats containing potting soil and grown for 1 week in a growth chamber, subsequently grown an additional 1-2 weeks in the greenhouse, and then transplanted to soil in pots and grown under greenhouse conditions.

To identify $T_0$ plants containing the desired haploid induction and/or genome modification and/or CRE expression cassettes and no RV020636 plasmid sequence, leaf tissue is sampled per plant and evaluated using PCR diagnostic methods. All plants observed to lack any RV020636 plasmid sequence and single copy of the plasmid containing an endosperm-mediated cellular reprogramming haploid inducer expression cassette and/or a genome modification expression cassette events are selected.

The RV020636 plasmid has a "3XENH-3XEME-WUS" expression cassette (FMV ENH:PSCV ENH:MMV ENH:ZM-(3XEMEs)-PLTP PRO::ZM-WUS2::IN2-1 TERM; SEQ ID NO: 134) which is useful for producing clonal doubled haploids. The recovered clonal doubled haploids typically will not contain this a T-DNA with this "3XENH-3XEME-WUS" expression cassette from plasmid RV020636 (SEQ ID NO: 134).

Using the methods of the present disclosure, it is expected that improved cellular reprogramming will be achieved resulting in improved levels of doubled haploid plant generation.

A useful aspect of endosperm-mediated cellular reprogramming is that the expression of the desired trait cassettes conferring cellular reprogramming and/or genome modification is expressed from the paternal allele of the endosperm. A benefit of this method for haploid induction methods is thus the activity of the proteins encoded in the trait cassettes that can be provided to a haploid cell without the necessity for the trait cassette to be integrated into the genome of the haploid cell. This mechanism is possible given that the triploid endosperm contains a paternal allele with the integrated trait cassette(s) and that the endosperm is a terminally differentiated tissue that does not contribute to germ line inheritance of the embryo.

The methods disclosed herein provide an increased flexibility in the choice of proteins that can be used to induce cellular reprogramming of a plant cell. It therefore expected that the activity of combinatorial factors disclosed herein can improve cellular reprogramming resulting in improved productivity gains for doubled haploid breeding methods. The use of various promoters and/or combinations of cellular reprogramming and/or genome modification activities further exemplify how the methods of the present disclosure provide technology improvements useful in plant breeding.

The design aspects that further comprise options of creating heterologous proteins wherein the translational fusion proteins are expressed having enhanced properties, for example increased protein secretion and/or increased cellular delivery of a genome modification nuclease, are also technology improvements useful to plant breeding.

It is expected that the expression cassettes disclosed herein, when transformed into either a known haploid inducer, or a non-haploid inducer, provide additional flexibility in practicing the methods disclosed herein. It is expected that this flexibility will lead to further improvements in haploid induction frequencies and/or improved haploid in vitro tissue culture responses in regard to reproductive success, including the fecundity of the produced $D_0$ plant as measured by the amount of Di seed produced thereof.

It is expected that protein delivery of a genome modification protein from the endosperm to the embryo cell can modify a cell that is not a germ cell. In that event, while such a plant can have a somatic cell mutation and may express a phenotypic change in the sporophytic stage of that plant's lifecycle, such a mutation will not be inherited in the next generation. It is therefore expected that upon rescuing embryos treated using these endosperm delivery methods those rescued embryos will have an improved response to the clonal propagation tissue culture methods disclosed herein. When the methods disclosed herein are used it is expected that the somatic embryogenesis stimulus provided to the embryo using the disclosed clonal propagation methods improves the probability for regenerating a haploid plant with a mutation at the target site.

Example 16: Targeted Gene Activation in a Plant Cell Using Deactivated Cas-Alpha Proteins The present disclosure describes methods for targeted gene regulation using a translational fusion protein comprising a Cas endonuclease. Cas endonuclease genes useful in these experiments are shown in Table 14.

TABLE 14

Cas-alpha (α) endonucleases

| Name | Organism | Casα SEQ ID NO: DNA | Casα SEQ ID NO: Protein | Class |
|---|---|---|---|---|
| Casα1 | Candidatus Micrarchaeota archaeon | 211 | 219 | Class 2 CRISPR-Cas system |
| Casα2 | Candidatus Micrarchaeota archaeon | 212 | 220 | Class 2 CRISPR-Cas system |
| Casα3 | Candidatus Aureabacteria bacterium | 213 | 221 | Class 2 CRISPR-Cas system |
| Casα4 | Uncultured bacterium | 214 | 222 | Class 2 CRISPR-Cas system |
| Casα5 | Candidatus Micrarchaeota archaeon | 215 | 223 | Cas-alpha proteins |
| Casα6 | Uncultured bacterium | 216 | 224 | Cas-alpha proteins |
| Casα7 | *Parageobacillus thermoglucosidasius* | 217 | 225 | Cas-alpha proteins |
| Casα8 | *Acidibacillus sulfuroxidans* | 218 | 226 | Cas-alpha proteins |

Use of a Cas endonuclease disclosed in Table 14 can comprise a modified form of the Cas polypeptide. The modified form of the Cas polypeptide can include an amino acid change (e.g., deletion, insertion, or substitution) that reduces the naturally-occurring nuclease activity of the Cas protein. For example, in some instances, a modified form of the Cas protein has less than 50%, less than 40%, less than 30%, less than 20%, less than 10%, less than 5%, or less than 1% of the nuclease activity of the corresponding wild-type Cas polypeptide. In some cases, the modified form of the Cas polypeptide has no substantial nuclease activity and is referred to as catalytically "inactivated Cas" or "degenerate Cas" or "deactivated Cas (dCas)". An inactivated Cas/degenerate/deactivated Cas includes a deactivated Cas endonuclease (dCas).

A deactivated Cas endonuclease (dCas) may be used with guide RNA to target a specific DNA target site having characterized properties of the guide RNA and PAM sequence to be used for each Cas-alpha CRISPR-Cas system.

A catalytically inactive Cas effector protein can be fused to a heterologous sequence comprising a regulatory domain resulting in a translational fusion protein acting as a cellular reprogramming factor. For example, including but not limited, use of a fusion protein for gene activation and/or a chromatin modifying domain as disclosed herein, wherein the regulatory domain induces or modifies gene regulation and/or to induces or modifies gene chromatin remodeling activity at a genomic target site.

A. Paternal Haploid Induction Utility

In the present disclosure, methods for targeted gene activation use dCas-alpha7 as an exemplary recognition domain of the fusion protein, for example a maize optimized dCas-alpha7 (DNA SEQ ID NO: 227; encoding protein SEQ ID NO: 228), fused with a polynucleotide encoding chromatin modification domains as defined in Table 8, or fused with a transcriptional activator component, such as a domain from the *Arabidopsis* CBF1 protein. Table 15 shows cellular reprogramming factor polynucleotides encoding polypeptides useful for targeted gene activation in a plant cell comprising deactivated Cas-alpha7 proteins.

TABLE 15 dCas-alpha7 cellular reprogramming factors

| Cellular Reprogramming Factor | Protein Fusion Domains Recognition | Protein Fusion Domains Regulatory | SEQ ID NO: DNA | SEQ ID NO: Protein |
|---|---|---|---|---|
| dCasα7-GNAT1 | dCasα7 | GNAT1 | 229 | 235 |
| dCasα7-GNAT2 | dCasα7 | GNAT2 | 230 | 236 |
| dCasα7-HAT1 | dCasα7 | HAT1 | 231 | 237 |
| dCasα7-HAT2 | dCasα7 | HAT2 | 232 | 238 |
| dCasα7-jmj | dCasα7 | jmj | 233 | 239 |
| dCasα7-CBF1a | dCasα7 | CBF1a | 234 | 240 |

To facilitate optimal expression and nuclear localization (for eukaryotic cells), the genes comprising the complex may be optimized and then delivered into cells as DNA expression cassettes by standard methods. The components necessary to comprise an active complex may also be delivered as RNA with or without modifications that protect the RNA from degradation or as mRNA capped or uncapped or Cas protein guide polynucleotide complexes, or any combination thereof as disclosed herein.

An exemplary expression cassette encoding the dCasα7-HAT1 cellular reprogramming factor useful for transient expression in a corn microspore to improve microspore embryogenesis is provided (SEQ ID NO: 241; features containing a 3x ENHANCER (FMV, PCSV, and MMV)+ Expansin promoter+Expansin 5' UTR+dCasAlpha7 exon1+

ST-LS1 INTRON2+dCasAlpha7_exon2(MO)_(TR1)+ VIRD2 NLS (TR2)+30XQ-V2+linker+HAT1+linker+PIN II TERM). Such an expression cassette encoding the dCasα7-HAT1 cellular reprogramming factor can be used as described herein.

In this Example, a method to recombinantly expression and purify deactivated Cas-alpha (dCasα) endonucleases is also described. Deactivated Cas-alpha translational fusion proteins as described in Table 15 can be expressed and purified using a tagged "solo" protein expression plasmid. First, the expression construct is transformed into either *E. coli* BL21(DE3) or ArcticExpress (DE3) strains and cultures are grown in LB broth supplemented with selective agent (e.g. ampicillin (100 µg/ml)). After culturing to an $OD_{600}$ of 0.5, temperature is decreased to 16° C. and expression induced with IPTG (0.5 mM) or arabinose (0.2% (w/v)). After 16 h, cells are pelleted and re-suspended in loading buffer (20 Tris-HCl, pH 8.0 at 25° C., 1.5 M NaCl, 5 mM 2-mercaptoethanol, 10 mM imidazole, 2 mM PMSF, 5% (v/v) glycerol) and disrupted by sonication. Cell debris is removed by centrifugation. The supernatant is loaded on the $Ni^{2+}$-charged HiTrap chelating HP column (GE Healthcare) and eluted with a linear gradient of increasing imidazole concentration (from 10 to 500 mM) in 20 Tris-HCl, pH 8.0 at 25° C., 0.5 M NaCl, 5 mM 2-mercaptoethanol buffer. The fractions containing dCas-alpha translational fusion proteins are pooled and subsequently loaded on a HiTrap heparin HP column (GE Healthcare) for elution using a linear gradient of increasing NaCl concentration (from 0.1 to 1.5 M). The next fractions containing a dCas-alpha fusion protein is pooled and the tag is cleaved by overnight incubation with TEV protease at 4° C. To remove cleaved His-MBP-tag and TEV protease, reaction mixtures are loaded onto a HiTrap heparin HP 5 column (GE Healthcare) for elution using a linear gradient of increasing NaCl concentration (from 0.1 to 1.5 M). Next, the elution from the HiTrap columns is loaded on a MBPTrap column (GE Healthcare) and a dCas-alpha fusion protein is collected as flow though. The collected fractions are then dialyzed against 20 mM Tris-HCl, pH 8.0 at 25° C., 500 mM NaCl, 2 mM DTT, and 50% (v/v) glycerol and stored at −20° C.

Such a purified protein encoding the dCasα7-translational fusion protein cellular reprogramming factor can be used as described herein.

It is expected that providing a dCasα-translational fusion protein activity to a plant cell will reprogram cell fate. More specifically, providing the protein activity to maize microspore can achieve cellular reprogramming, thereby resulting in improved microspore embryogenesis useful for obtaining a paternal haploid plant.

It is also expected that using dCas alpha recognition domain allows for increased flexibility in gRNA design options. For example, reliance on cellular reprogramming using only dCas9 fusion proteins limits gRNA designs to DNA sequence target sites with a "NGG" protospacer adjacent motif (PAM) immediately following the target site. In the methods of the disclosed herein, target sites comprising a DNA sequence target immediately following the corresponding protospacer adjacent motif (PAM) sequence per Cas alpha protein can be designed and used in the methods disclosed herein.

The methods disclosed herein enables combing dCas9- and dCasα-translational fusion proteins to be concurrently targeting different DNA sequence targets at the same genetic locus, including but not limited to combinations of resulting gene regulatory mechanisms to simultaneously occur within a treated cell. For example, it is expected that combining protein activities conferring both chromatin modification and transcriptional activation can be achieved. It is expected such combined activity will improve microspore embryogenesis in treated cells. It is also expected that methods for expressing, purifying, and providing a dCasα-translational fusion protein complexed with a synthetic gRNA molecule will achieve improved cellular uptake. The dCasα7 peptide described herein is 424 amino acid residues. Thus, it is expected that delivery of this smaller peptide will result in improved cellular uptake into a plant cell.

B. Maternal Haploid Induction Utility

The methods of the present disclosure describe obtaining a transgenic haploid plant by introducing an expression cassette into a plant genome expressing a heterologous protein that binds to a target locus in a plant cell, wherein the heterologous protein comprises a deactivated Cas alpha (dCasα) translational fusion, for example using a Cas alpha peptide disclosed in Table 14. This method is used to recruit the deactivated Cas alpha (dCasα) translational fusion polypeptide to a target locus in the plant genome wherein a target site is a genetic locus encoding an embryogenesis factor and/or a morphogenic developmental gene, or by recruiting deactivated Cas alpha (dCasα) translational fusion polypeptides to any combination of these target sites.

The methods of the present disclosure include designs for heterologous proteins comprising a degenerate, also known as deactivated, Cas alpha protein (dCasα) fused to a chromatin modification domain. The dCasα-fusion protein is recruited to a target locus encoding each embryogenesis factor and/or morphogenic developmental gene using guide RNAs (gRNAs). Once the ribonucleotide complex is recruited to the target locus, cellular reprogramming is achieved by altering post-translational modifications of histone modifications, including (a) removing histone modifications associated with repressing gene expression, (b) establishing histone modifications associated with promoting gene expression, and/or (c) recruiting transcriptional machinery associated with expressing the target locus.

In the present disclosure provides a dCas9 technology useful for a maternal doubled haploid method. As described herein, the prese dCas alpha technology is useful in the methods of the present disclosure for cellular reprogramming activity in an unfertilized egg cell resulting in methods useful for producing maternal doubled haploids.

For example, expression cassettes encoding any of the dCasα proteins disclosed in Table 14 can be used in the methods of the present disclosure. More specifically, expression cassettes containing a polynucleotide encoding a polypeptide comprising a dCasα recognition domain fused to a polynucleotide comprising an activator domain, for example as described in Table 8 can be used in the methods of the present disclosure.

Alternatively, an expression cassette containing a polynucleotide encoding a dCasα recognition domain fused to a polynucleotide encoding the transcriptional activator component of *Arabidopsis* CBF1 domain (polynucleotide SEQ ID NO: 242, encoding polypeptide SEQ ID NO: 243) or a polynucleotide encoding the transcriptional activator VP64 component (polynucleotide SEQ ID NO: 244, encoding polypeptide SEQ ID NO: 245) can be used in the methods of the present disclosure.

For maternal haploid induction, an expression cassette containing a polynucleotide encoding a dCasα translational fusion protein operably linked to a promoter expressing in an egg cell to promote parthenogenesis, which is and development of a maternal embryo that occurs without fertilization can be used in the methods of the present disclosure.

These methods can require fertilization for proper endosperm development, while fertilization is not required for a parthenogenic, maternal haploid embryo. Thus, in this aspect the present disclosure is considered a method of pseudogamy given this maternal haploid induction method requires pollination that does not involve male inheritance.

It is expected that providing a dCasα-translational fusion protein to an egg cell will result in parthenogenic maternal haploid induction. The methods disclosed herein provide improved flexibility for gRNA designs, whereby DNA sequences at desired targets sites can be designed using PAM sites other than the "NGG" base pair sequence required when using dCas9 recognition domains.

It is also expected that combining protein activities conferring both chromatin modification and transcriptional activation can be achieved when multiple PAM sites are used, thus, it is expected such combined activity will improve egg cell parthenogenesis when using such combined protein activities.

Example 17: Methods for Genetic Chromosome Doubling

The methods of the present disclosure describe methods for non-chemical chromosome doubling.

This method comprises obtaining a doubled haploid by genetically disrupting the canonical G1-S-G2-M cell cycle by transiently allowing replication of a haploid genome without cell division. The method uncouples the standard cell cycle regulation, specifically the step wherein progression to DNA synthesis phase (S-phase) requires completion of chromosome separation (M-phase).

This method mimics naturally occurring endoreduplication by allowing chromatin to reduplicate in the absence of mitosis. Proliferating cells treated with plasmid RV020636 have a high mitotic index. This method simultaneously uses a non-chemical chromosome doubling method by transiently expressing a protein, herein referred to as a genetic chromosome doubling protein during a cellular reprogramming step to allow clonal production of doubled haploids.

One option is co-expressing a genetic chromosome doubling protein from a Ti plasmid beyond the T-DNA border, for example by transferring a polynucleotide encoding the protein into a Ti plasmid and operably linking the polynucleotide to a promoter of an *Agrobacterium tumefaciens* Ti-plasmid virulence gene. Such promoters useful to the present disclosure are the virF and virB promoters (SEQ ID NO: 403, SEQ ID NO: 404, respectively). Transient expression can be achieved by controlling conditions required for the *Agrobacterium*. For example, when using the auxotrophic *Agrobacterium* strain LBA4404 THY- lacking thymidylate synthetase activity the absence of thymine in the growth media will reduce *Agrobacterium* viability, thereby reducing expression of the protein disrupting the G1-S-G2-M cell cycle regulation.

Another option is using *Agrobacterium tumefaciens* Ti-plasmid virulence gene promoters that are acetosyringone-inducible and to alter acetosyringone concentrations as needed during in vitro tissue culture steps, thereby transiently regulating protein expression. Optionally, a combination of both methods can be practiced.

As described above, the methods of the present disclosure allows obtaining a doubled haploid by genetically disrupting the canonical G1-S-G2-M cell cycle. This method transiently allows replication of the genome without cell division. An exemplary protein useful for stimulating genome duplication in the absence of completing the M-phase, characterized by completing cytokinesis and producing two daughter cells, is the mitotic inhibitor cell cycle switch 52 protein (CCS52). It is believed CCS52 can block mitosis by degrading mitotic cyclins, leading to endocycles comprising G1-S-G2 phases. Thus, it is expected that the CCS52 protein will be useful as a genetic chromosome doubling protein.

The CCS52 protein is a plant homologue of Anaphase-promoting complex activators ("APC"; also, called the "cyclosome") that are involved in mitotic cyclin degradation, wherein the APC components comprise an E3 ubiquitin ligase that degrades targeted cell cycle proteins via the 26S proteasome. Overexpression of WD-repeat containing yeast protein similar to ccs52 triggered mitotic cyclin degradation, cell division arrest, endoreduplication and cell enlargement.

Transient expression of the CCS52 protein is achieved using an expression cassette containing a polynucleotide sequence encoding a *Zea mays* FIZZY RELATED protein, for example *Zea mays* FIZZY-RELATED 2-like (polynucleotide SEQ ID NO: 136, encoding polypeptide SEQ ID NO: 197), and/or a different FIZZY-RELATED homolog (polynucleotides SEQ ID NOS: 137-139; encoding polypeptides SEQ ID NOS: 198-200, respectively), operably linked to a promoter of an *Agrobacterium tumefaciens* Ti-plasmid virulence gene, for example either the virF or virB promoter (SEQ ID NO: 403, SEQ ID NO: 404, respectively). When such a Ti plasmid is transferred into the auxotrophic *Agrobacterium* strain LBA4404 THY- lacking thymidylate synthetase activity, then transient expression can be achieved by controlling conditions required for the *Agrobacterium* as described above.

A second genetic method for genetically disrupting the canonical G1-S-G2-M cell cycle is to transiently express a protein inhibiting tubulin polymerization, thereby mimicking the anti-mitotic action of chemicals used as chromosome doubling agents.

Eukaryotic cells express several tubulin proteins, with the α- and β-tubulin being the main components of microtubules. Microtubules for the mitotic spindle provides the framework for separating daughter chromatids during mitosis. Microtubules are comprised of 13 filaments and each filament is end-to-end heterodimers of α-β-tubulin that is laterally associated into a tube-like structure. Tubulin proteins are GTPases with an active site formed at the interface between subunits, using essential amino acid residues from both subunits. Moreover, GTPase activity only occurs when 2 or more subunits are associated, wherein the N-terminal domain of one subunit provides a nucleotide binding site and the C-terminal domain provides a "T7 loop" responsible for nucleotide hydrolysis.

The method of the present disclosure disrupts microtubule polymerization. For example, by expressing a mutated β-tubulin subunit, specifically in the N-terminal domain of the subunit providing nucleotide binding site, then nucleotide hydrolysis is prohibited. Thus, the mutated β-tubulin subunit acts as a "poisonous" subunit, or a dominant negative mutation, blocking polymerization on the (+) end of the polymer, thereby inhibiting filament polymerization. Thus, expressing a mutated tubulin subunit causes dynamic instability of filaments causing an anti-mitotic mode of action useful as a genetic chromosome doubling agent.

Co-expressing a mutated β-tubulin subunit from a Ti plasmid in a region beyond the T-DNA border, for example as described above during *Agrobacterium* treatment steps using RV020636, can be performed using a polynucleotide encoding a mutated tubulin subunit. For example, an exemplary method is described to create missense mutations within a conserved site, such as the tubulin conserved site, Prosite accession number PS00227, wherein a polynucleotide is used encoding missense mutations, herein called "β-tubulin-PS00227minus" (polynucleotide SEQ ID NO: 140; encoding SEQ ID NO: 141). Such a polynucleotide can be operably linked to a promoter, such as the either a virF or virB promoters (SEQ ID NO: 403, SEQ ID NO: 404, respectively), linked to a SV40 nuclear localization signal sequence.

Alternatively, expressing the genetic chromosome doubling protein using a polynucleotide within the borders of a T-DNA can be performed. For example, an expression cassette containing a polynucleotide encoding the genetic chromosome doubling protein, or proteins, can be transferred into a T-DNA, wherein transient expression is achieved from the T-DNA after being delivered into the plant cell. An exemplary sequence for such an expression cassette encoding a mutated β-tubulin "PS00227 minus" is provided (OS-ACTIN PRO::OS-ACTIN INTRON1 (MOD1):: β-tubulin-PS00227minus::CAMV35S TERM; SEQ ID NO: 142).

A benefit associated with the use of this genetic method is that the *Agrobacterium* strain is expressing the genetic chromosome doubling protein required for chromosome doubling, and thus it is not required for a transgene or mutation to be introduced into the plant genome, nor for any such change to revert to wild type mitotic spindle activity during mitosis. Such methods are thus inherently transient. Additionally, the presence/absence of acetosyringone in various culture media as desired can alter gene expression levels when using the genetic chromosome doubling protein linked to the virB promoter, thus providing an additional method for controlling transient expression.

This genetic method can be improved using translational fusions, wherein delivery of the genetic chromosome doubling method into the plant cell is improved using a translational fusion of a virulence gene translocation factor to the protein acting as the genetic chromosome doubling protein. As described herein, a translational fusion polypeptide encoding a protein acting as a genetic chromosome doubling protein is fused, often at the N- or C-terminus of the protein, with a polypeptide derived from bacterial virulence proteins that confers in planta translocation of secreted proteins. This method promotes improved in planta translocation of secreted genetic chromosome doubling protein to cells that have been treated with a cellular reprogramming agent.

The methods of the present disclosure provide exemplary sequences for polynucleotides encoding such secreted genetic chromosome doubling proteins. One exemplary sequence is a polynucleotide (SEQ ID NO:143) comprising a translational fusion protein of the β-tubulin (PS00227 minus) peptide fused to the C-terminal 36 amino acids of the *Agrobacterium tumefaciens* VirF translocation/nuclear localization motif encoding (SEQ ID NO:144). A second exemplary sequence is a polynucleotide (SEQ ID NO:145) comprising a translational fusion protein of the β-tubulin (PS00227 minus) peptide fused to the C-terminal 27 amino acids of the *A. rhizogenes* GALLS protein translocation/nuclear localization motif encoding (SEQ ID NO:146 encoding SEQ ID NO:147). Either polynucleotide can be operably linked to a promoter of an *Agrobacterium tumefaciens* Ti-plasmid virulence gene, for example either the virF or virB promoter (SEQ ID: 403, SEQ ID: 404, respectively). It is expected that such a method can be performed using polynucleotides encoding other genetic chromosome doubling proteins, for example FIZZY RELATED polynucleotides (SEQ ID NOS: 136-139), in a similar manner.

As disclosed herein, it is expected that a haploid embryo can be doubled using chemical chromosome doubling proteins that modulate expression of genes known to impact the plant cell cycle. It is expected doubled haploid production will be improved using this genetic chromosome doubling method disclosed herein.

Example 18: Method for Conditional Negative Selection

Negative selection systems can be used in any of the methods disclosed herein to select against transgenic cells or resulting transgenic plants thereof, thereby avoiding the production of transgenic "escapes", which is a transgenic plant containing an undesirable expression cassette, or T-DNA. The methods of the present disclosure describe using conditional negative selection methods in plant cells that result in death of certain transformed cells containing an undesirable expression cassette, or T-.

In these conditional negative selection methods a cell is first cultured using a growth medium without a non-toxic agent, thereby allowing growth of both transformed and non-transformed cell. Second, a cell is transferred to a growth medium with a non-toxic agent, thereby promoting selection against a transformed cell and selective growth of a non-transformed cell.

In the methods of the present disclosure, a gene conferring conditional negative selection, for example the bacterial cytosine deaminase (codA) gene, is transferred into a plasmid using standard methods. Here, the codA gene is transferred into any expression cassette, or T-DNA, that is not desired in a cell, tissue, or plant that is the product of the methods disclosed herein. For example, the T-DNA of plasmid RV020636 and/or PHP87078.

*Agrobacterium* transformation is carried out as described herein except that during in vitro culture a cell that is cultured without selection is transferred a maturation medium with selection, for example the 289Q medium supplemented with 5-fluorocytosine. A cell containing an undesirable T-DNA expressing the codA gene will metabolize 5-fluorocytosine into a toxic agent and will be selected against, whereas a non-transformed cell will be unaffected by 5-fluorocytosine, thereby promoting selection against a transgenic "escape" and promoting selective growth of a desirable cell. Conditional selection methods can be practiced at other steps during tissue culture, for example during or after proliferating callus tissue of each treated haploid embryo is cultured and/or dissected. For example, conditional selection can be performed by transferring each portion of dissected tissue to maturation medium (289Q) supplemented with 5-fluorocytosine that is then cultured at 26-28° C. under dark conditions.

It is expected the methods of the present disclosure will produce elevated frequencies of non-transgenic plants being derived from a plant propagated in response to an *Agrobacterium* treatment, for example, an *Agrobacterium* strain containing a T-DNA of plasmid RV020636 and/or PHP87078 and a gene conferring conditional negative selection.

Example 19: Targeted Gene Repression in a Plant Cell Using Deactivated Cas-Alpha Proteins These methods comprise methods useful in plant breeding, wherein the methods comprise repressing a cell's initial cell fate, thereby improving cellular reprogramming of a plant cell and plant regeneration frequencies. The present disclosure describes methods for targeted gene repression using a translational fusion protein comprising a Cas endonuclease. It is also expected that the repression domains disclosed herein can be fused to other modified Cas nucleases, including but not limited to a modified Cas9 protein (DNA SEQ ID NO: 357 encoding SEQ ID NO: 368) or a Cpf1 protein (DNA SEQ ID NO: 359 encoding SEQ ID NO: 360).

As disclosed herein, multiple methods enhance embryogenic cellular reprogramming in a plant cell using any of the embryogenesis factors described in Table 6 alone and/or in combination with a morphogenic developmental protein. In methods providing an embryogenesis factor with or without a morphogenic developmental protein to a cell, it is expected that ectopic activity of such an embryogenesis factor with or without a morphogenic developmental protein will cause a cellular response, for example a response to repress an induced cellular reprogramming stimulated by providing an embryogenesis factor with or without a morphogenic developmental protein to a cell. Methods to overcome a plant cell's repression of cellular reprogramming are provided.

An exemplary pathway for maintaining stem cell homeostasis in plant cells wherein shoot meristems are maintained by pluripotent stem cells is the CLAVATA-WUSCHEL feedback signaling pathway. This pathway coordinates maintaining stem cell proliferation with differentiation. This pathway appears to be conserved in diverse higher plant species. The pathway comprises the stem cell-promoting transcription factor WUS and the differentiation-promoting peptide CLAVATA3 (CLV3) Multiple receptors function in regulating stem cell and development in plants, such as the rice gene FON1, the *Zea mays* CLAVATA 2 orthologs THICK TASSEL DWARF1 (TD1) and FASCIATED EAR2 (FEA2), and the *Zea mays* CLV-type LRR receptor-like gene, FASCIATED EAR3 (FEA3). These proteins can repress induced cellular reprogramming provided by a treating a cell with an embryogenesis factor and/or a morphogenic developmental protein. It is expected that modulating these repressive proteins will enhance the methods of inducing cellular reprogramming disclosed herein.

Developmental regulation of the *Arabidopsis thaliana* floral meristem has shown that repression of WUS is controlled by expression the AGAMOUS (AG) protein. AG directly induces the transcription of KNUCKLES (KNU), encoding a C2H2-type zinc finger protein with a conserved transcriptional repression motif, that represses WUS transcription to abolish stem cell activity, thereby controlling floral meristem determinacy. For this pathway of stem cell regulation in flower development, a key aspect to coordinating stem cell maintenance and differentiation is not only temporal expression patterns, wherein WUS activity activates AG activity, and AG activates KNU transcription, but also in how the KNU locus in regulated. KNU transcription by AG requires removal of a repressive histone modification at the KNU locus, for example removal of tri-methylation at the 27th lysine residue of the histone H3 protein (H3K27me3). This repression is removed in an AG-dependent manner. It is expected that in the methods of the present disclosure wherein WUS activity has a mechanistic link between transcriptional feedback and epigenetic regulation in plant stem cell proliferation, it is expected that targeted repression of a positively activated WUS repressor, such as KNU or other such repressor proteins, will enhance cellular reprogramming.

It is expected that ectopic WUS protein activity in a plant cell will positively regulate signaling pathway responses to repress WUS activity. Genetic loci encoding proteins acting to repress WUS activity are useful as genomic target sites for methods of the present disclosure. It is expected that modulating these repressive proteins will enhance the methods of inducing cellular reprogramming disclosed herein.

Several other genetic loci acting as negative switches of embryogenesis have also been identified. The PICKLE (PKL) gene encodes a CHD3 chromatin-remodeling factor and embryonic traits ectopically developed within roots when a loss of PKL function occurred. In pkl seedlings, LEC-class genes were derepressed, thereby showing that such developmental genes are silenced via repressive chromatin.

Plant cells use conserved genetic and epigenetic pathways to mediate developmental shifts from an embryogenic to non-embryogenic phase, for example by using repressors and epigenetic silencing via repressive chromatin modifications to maintain a differentiated, non-embryogenic state. The methods of the present disclosure reverse such a repressive non-embryogenic state, including but not limited to methods that repress expression of an embryogenic repressor protein, such as CLV3, KNU, or PKL, and/or remove established repressive chromatin modifications at a genomic target site encoding a useful cellular reprogramming factor, such as a morphogenic developmental gene and/or the embryogenic factors described in Table 6.

It is expected that modulating repressive proteins will enhance the results obtained by the methods disclosed herein including but not limited to methods of improving microspore embryogenesis, methods of improving parthenogenesis, methods of improving somatic embryogenesis, and methods of improving plant transformation efficiencies. It is expected that a multitude of possible target sites can be considered, wherein the genomic target site encodes a product characteristically promoting that cell's initial cell fate. The methods disclosed herein provide improved methods for treating a cell to reprogram that cell's initial cell fate to an altered embryogenic cell fate. Cas endonucleases useful in the methods are shown in Table 14 and are used to create translational fusion proteins conferring targeted gene repression.

More specifically, the recognition domain of a translational fusion repressor protein can use a modified form of the Cas polypeptide that has no substantial nuclease activity and is referred to as catalytically "inactivated Cas" or "degenerate Cas" or "deactivated Cas" (dCas). An inactivated Cas/degenerate/deactivated Cas includes a deactivated Cas endonuclease (dCas). A deactivated Cas endonuclease (dCas) may be used with guide RNA to target a specific DNA target site as described herein with characterized properties of the guide RNA and PAM sequence for each Cas-alpha CRISPR-Cas system.

For the methods of the present disclosure, a catalytically inactive Cas alpha peptide can be fused to a heterologous sequence comprising a regulatory domain resulting in a translational fusion protein acting as a cellular reprogramming factor. For example, a fusion protein useful for gene repression wherein the regulatory domain contains a repressor motif having the capability to repress transcription at a genomic target site.

Exemplary motifs useful in the methods of the present disclosure are shown in Table 16.

TABLE 16

| Name | DNA SEQ ID NO: | DNA Seq | Peptide SEQ ID NO: | Peptide Seq |
|---|---|---|---|---|
| ERF motif 1 | 365 | CGCCTGTTCGGCGTC | 373 | RLFGV |
| ERF motif 2 | 366 | AAGCTGTTCGGCGTC | 374 | KLFGV |
| AP2/ERF motif 1 | 367 | CACTACCGCGGCGTCCGC AAGCGCCCG | 375 | HYRGV RKRP |
| AP2/ERF motif 2 | 368 | CGCTTCCGCGGCGTCCGC AAGCGCCCG | 376 | RFRGV RKRP |
| TLLLFR motif | 369 | ACCCTGCTGCTGTTCCGC | 377 | TLLLFR |
| Dr1-like | 370 | ACCCTGCTGCTGCAGCCG | 378 | TLLLQP |
| Zinc Finger motif (DLN-like) | 371 | TTCGACCTGAACCTGCCG | 379 | FDLNLP |
| B3 motif | 372 | CGCATCGGCCGCCTG | 380 | RIGRL |

The present disclosure provides methods of treating a cell with an initial cell fate characteristic of a somatic cell, thereby resulting in a non-somatic cell fate, thereby resulting in an improved acquisition of a pluripotent stem cell fate in the cell.

The present disclosure provides methods of treating a cell with an initial cell fate characteristic of a gametophyte developmental pathway, thereby resulting in a non-gametophytic cell fate and furthermore an improved acquisition of an embryogenic cell fate in the cell. The present disclosure provides methods of perturbing megagametogenesis that produces a mature female gamete cell and methods of perturbing microgametogenesis that produces a mature male gamete.

It is expected that the methods disclosed herein will improve treated embryogenic cells' ability to divide and proliferate and improve plant regeneration from such treated embryogenic cells.

A polypeptide useful in the methods disclosed herein comprises a Cas-alpha (α) endonucleases as shown in Table 14, which can be modified wherein the recognition domain comprises a dCasα nuclease fused to any of the repressor motifs described above, thereby resulting in a dCasα-repressor translational fusion.

A dCasα-repressor translational fusion polypeptide useful in the methods disclosed herein can be complexed with a gRNA comprising a dCasα-repressor-gRNA ribonucleoprotein complex (RNP) wherein the gRNA allows binding to a genomic target site. Activity of such a repressor RNP in a cell can allowing binding to a target site and altered gene expression, specifically repressed gene expression.

As disclosed herein, chromatin modifying domains are regulatory domains useful as cellular reprogramming agents capable of targeted gene activation. A dCasα-repressor translational fusion with a regulatory domain comprising a chromatin modifying domain conferring transcriptional gene silencing are useful in the methods disclosed herein. Such chromatin modifying domains include but are not limited to DNA methyltransferase domains and/or histone methylation domains useful for establishing or maintaining transcriptional gene silencing at a genomic target site.

A fusion protein containing a repressor motif contained in the WUSCHEL protein is useful in the methods disclosed herein. For example, the EAR-like "LELRLN" (SEQ ID NO:408) repressor motif found in the *Arabidopsis thaliana* WUSCHEL peptide, the so-called WUSCHEL box domain, "TLPLFPTCG", (SEQ ID NO:398) that may also comprise the so-called WUSCHEL Box domain and an acidic domain, "TLPLFPTCGDDDDDD" (SEQ ID NO:409) are useful in the methods disclosed herein. The methods disclosed herein can repress differentiation pathways by recruiting co-factors, thereby suppressing a cell's initial cell fate, allowing improved cellular reprogramming, and promoting stem cell regulation resulting in an altered cell fate for a treated cell. Providing a fusion protein comprising a dCasα-WUS box fusion to a cell can be useful to promote cellular reprogramming, thereby resulting in an improved embryogenic response of a treated cell.

To exemplify using a dCasα repressor translational fusion protein, sequences useful as regulatory domains containing a repressor motif are shown in Table 17. It is expected that polynucleotide sequences comprising the additional motifs described in Table 16 can also be used.

TABLE 17

| Motif | DNA SEQ ID NO: | Peptide SEQ ID NO: |
|---|---|---|
| RLFGV-like-1 | 381 | 389 |
| RLFGV-like-2 | 382 | 390 |
| RLFGV-like-3 | 383 | 391 |
| RLFGV-like-4 | 384 | 392 |
| *Triticum aestivum* repressor | 385 | 393 |
| Dr1-associated corepressor-like 1 | 386 | 394 |
| Dr1-associated corepressor-like 2 | 387 | 395 |
| Dr1-associated corepressor-like 3 | 388 | 396 |
| WUSCHEL Box | 397 | 398 |

A. Method for Improving Somatic Embryogenesis and Obtaining a Stably Transformed Plant It is expected that improved induction of somatic embryogenesis will be achieved by providing to a cell a dCasα-repressor translational fusion polypeptide complexed with a gRNA comprising a dCasα-repressor-gRNA ribonucleoprotein complex (RNP) before, during or after treatment of a cell using the methods disclosed herein.

It is expected that improved cellular reprogramming will be achieved using dCasα-repressor translational fusion polypeptides with a recognition domain comprising a modified peptide as described in Table 14 and a regulatory domain containing a repressor peptide comprising a motif or domain as described in Tables 16 and 17.

Repression target sites useful in the methods disclosed herein can include but are not limited to a genomic locus encoding a repressor of a morphogenic developmental gene and/or an embryogenesis factor, such as loci encoding peptides described herein. Repression target sites that are components of stem cell signaling pathways such as CLV3, and the species-specific proteins thereof, a C2H2-type zinc finger protein repressing WUSCHEL, such as a KNUCKLES repressor protein, and a MADS-box transcription factor, such as AGAMOUS or a species-specific AGAMOUS-like ortholog are useful in the methods disclosed herein.

Repression target sites useful in the methods disclosed herein can include but are not limited to a genomic locus encoding a polycomb-group (PcG) protein, or subunit thereof, acting to repress expression of a genomic locus encoding a morphogenic developmental gene and/or an embryogenesis factor.

Repression target sites useful in the methods disclosed herein can include but are not limited to a genomic locus encoding a CHD3 chromatin-remodeling factor, or subunit thereof, acting to repress expression of a genomic locus encoding a morphogenic developmental gene and/or an embryogenesis factor.

It is expected that activity of a dCas-repressor proteins will further improve the frequency of obtaining a stably transformed plant, for example the frequency for obtaining a diploid plant regenerated from a diploid cell initially having a non-embryogenic cell fate relative to the frequency of obtaining a stably transformed plant when not using such a dCas-repressor protein.

B. Method for Improving Microspore Embryogenesis and Obtaining a Paternal Haploid Plant Further improvements in microspore embryogenesis are achieved by providing to a cell a dCasα-repressor translational fusion polypeptide complexed with a gRNA comprising a dCasα-repressor-gRNA ribonucleoprotein complex (RNP) before, during or after treatment of a cell using the methods disclosed herein.

It is expected that improved cellular reprogramming will be achieved using dCasα-repressor translational fusion polypeptides with a recognition domain comprising a modified peptide as described in Table 14 and a regulatory domain containing a repressor peptide comprising a motif or domain as described in Tables 16 and 17.

Repression target sites useful in the methods disclosed herein can include but are not limited to a genomic locus encoding a repressor of a morphogenic developmental gene and/or an embryogenesis factor, such as loci encoding peptides described herein. Repression target sites that are components of the microgametogenesis pathway, comprising a genomic locus encoding a protein conferring a role for developmental maturation of a pollen grain are useful in the methods disclosed herein.

Following regeneration of a haploid plant, chromosome doubling methods described above can be performed to obtain a paternal doubled haploid plant.

C. Method for Improving Parthenogenesis and Obtaining a Maternal Haploid Plant

Further improvements in parthenogenesis are achieved by providing to a cell a dCasα-repressor translational fusion polypeptide complexed with a gRNA comprising a dCasα-repressor-gRNA ribonucleoprotein complex (RNP) before, during or after treatment of a cell using the methods disclosed herein.

It is expected that improved cellular reprogramming will be achieved using dCasα-repressor translational fusion polypeptides with a recognition domain comprising a modified peptide as described in Table 14 and a regulatory domain containing a repressor peptide comprising a motif or domain as described in Tables 16 and 17. Repression target sites that are components of the megagametogenesis pathway, comprising a genomic locus encoding a protein conferring a role for developmental maturation of an egg cell are useful in the methods disclosed herein.

Following regeneration of a haploid plant, chromosome doubling methods described above can be performed to obtain a maternal doubled haploid plant.

SEQUENCE LISTING (423 sequences)

SEQ ID NO: 1 - DNA, 1047 bp, Zea mays
atgtgggacggaggcgtcgagcacgggagccaggaggccgcgcaccagctgctcccgtggctcggcgcggcgcccttctccgagccggcggccgtggcgggcctcggcgccgccatgggggcctacgcctgcgacggcgtcggcgggctcgggcatggcggggtgttcggcttcggtttcgacgccgcggtgcagcagcagcagcagcagcagcgcgcggcggacgggagcggcaaggcggtggtggtgtccgggctgctggggagcctgcaggcggagctggggcggatgacggcacgggagatgatggacgccaaggcgctggcggcctcgcgcagccacagcgaggccgagcgccgccgccggcagcggatcaacggccacctcgccaggctcaggagccttctccccaacaccaccaagacggacaaagcgtcgctgctggccgaggtgctggaccacgtgaaggagctgaagcgccagacctcggcgatgatggcggccaccgacgccgacgccgacgccgacgacgaaggcgccgggcggacgcaggcgcaggcgcaggcgcagctgctgccgacggaggccgacgagctgtgcgtggacgcgggggccgacggcgccggccggctcgtggtgcgcgcgtcgctctgctgcgaggaccgcccggacctcatcccggacatcgtccgcgcgctggccgccctccagatgcgcgcgcgccgggccgagatcaccacgctcggcgggcgcgtccgcagcttgctcctcatcaccgcggacaggagagcggacgtccagcgcggcggcggcggcggcggcggcgacggcgacgacgacgaggaggaggaggatgaggaggagggcggcgagcgcgctgcctcgcaccggaggcacgagtgcatcgcgtcggtccaggaggccctgcgcggcgtcatggaccgcaggacggccagcagctgcgacacgtcgtcgtctggtggcggcggcgggagcattaagcggcagcgcatgaactacggcgcgcaggagcagtgttcggtgtag

SEQ ID NO: 2 - DNA, 1068 bp, Zea mays
atggtgcctggctatgactgcgccgcctccgtgctgctgtgcgcggaggacaacgctgctgttctcggcctggacgacgagtcctcttgggcggccgcagctacgccgccacgcgacaccgtcgtcgccgccgccgccgccggggttgccgtcgacgggttcttgacggagttccccttgctctcggatgactgcgttgcggcgctcgtggagaaggaggtggagcacatgcccgcggaggggtacctccagaagctgcagcgacggcatggggacctggatttggccgccgtcaggaaggatgccgtcgactggatttggaaggtcattgaacattacagtttcgcaccgttgactgcagttctgtctgtgaactacctcgatagattcctctccacctatgactttcctgaaggcagagcttggatgactcagctcttagcagtggcatgcttgtctttggcttcgaaaatagaagagacttttgtgccactccctttggatttgcaggtagccgaggcaaagtttgtttttgagggaaggaccattaaaaggatggagcttctggtgctacgcaccttaaagtggaggatgcatgctgttactgcttgttcatttgttgaatactttcttcataaattgagtgaccatggtgcaccctccttgcttgcgcgctctcgctcttccgaccttgtcttgagcactgctaaaggtgctgaattcgtggtattcagaccctcagagattgctgccagtgttgctcttgcggcgatcggggaatgcagcagttctgtaattgagagagctgctactagctgcaactatttggacaaggagagggttttaagatgtcatgaaatgattcaagagaagattgctgtgggaagcattgtcctaaagtctgctggatcatcaatttcctctgtgccacgaagccccataggcgtcctggatgccgctgcctgtctgagtcaacaaagcgatgatgctactgttggatctcctgcagtatgctaccatagttcttccacgagcaagagaagaaggatcactagacgtctactctag

SEQ ID NO: 3 - DNA, 1215 bp, Zea mays
atgaaaggcacaccctattggatggcacctgaagtcattgttgggagtgggcatagcttttctgcagatatatggagtgtagggtgcacagtcattgaaatggccactggcaaaccaccatggagccagcagtatcaagaagttgctcttctatttcatgttggaactacaaaatcgcatccacctatacctgaacatctatcgccagaagccaaagattttctgctaaagtgcctgcagaaggaaccagagctgaggtctactgcaccagacttattaaagcatccttttgtcactggagaattggatgacctgcagccactcaatcatgctgcacgcaagaactcttttaatgagattccttcagatgatatgccaaatggcttgggtttgaataagtcttccaactggtccactatgaactccagtaaatcatccaaaatcaagcccttatgggagggtggctgtgatgatgatgacatgtgtgagtttgctgacaaggatgactatgcaggagttggatctagctataatcctatgtcagaaccatttgataactgggaaaacaagtttgacataagcccagagcaaaattctcatcaaccaatggaatttggtgaattggccaaacatgttgaaagcagcataactgggaatgattttacgttccctgttgggggaagttgtgaagatgatgatgtacttacagagtcaaaaataaaggcatttcttgaggagaaggctcttgacctgaaaaagctacaaacacctttgtatgaggagttctacaacactgtgcatggagggagttttcagggagctgatcaaacttccaagggaaaactcccaattagtccaaaatttccccctcgaggaaagtcgcctccatgcaagacacgtgtaggtgcatgtgatacttcgaatgacacagctcctgaaagctgcagcaagcaatttccaagaagcagtgtggtggatagcagccgaattttgagagaaattgcttctcctcaactgaatgagtttgcggataaaatccatcttgatgcccaagatagcccaagcatcagcttcaccgaaaggcagaggaagtggaaagaagagttggaccaggaacttgagagggagagagtgctgagattagctggctgtggtaaagcaccatccccaaacagaggttccaacgtgaaaaaggagtatcatgctgaccattga

SEQ ID NO: 4 - DNA, 372 bp, Zea mays
atggctgctccgaagctcgcgacgctggcgctggccgtgctcctggcggcgaccgtggtggctcccccggccgcggtgcgcgcggcgatgtcgtgctccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaactgcaacacgattaattaa

SEQ ID NO: 5 - DNA, 1068 bp, Zea mays
atggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatga

SEQ ID NO: 6 - DNA, 1782 bp, Zea mays
atggggacctcttctggcgcgaatttccatcagcaacctcctccgacccaggggatgttgcctccaaggcatggtccacgcccctcagggttgcagacctcgctctcgctggcctcttcggagcaggttggctcgcctgacatgcaggagcctggttcaaactcggagccagggcatgattccgccactgagagcgccagttccaaagacacatggccagctgagccgaaccagagcaatggtggagtggctgccagtgatgttgtgagtaaggcggcggagaaggaggtggcaaatggtgtatccaagccgcaggttatccatggaccctcctcccgtatgagtgggatgcttctgcgggaggttgcacgggagagggttgatctggtcgctgagaagatgaagatgatgtcggatgagcacctagaggaggtcaagaatgagctcaggtcgattctggagggcactggaggttctcaccacatcgaggagttcttgtacttgcagaagcttgtccaggacaggcatgatttgacaccatccatgctttcagtggcacaccatgtgcagcttgagatccttgttgcaatcaagactgggatacaggcctttctgcaccccagtgttaccattccacacaatcgcttggtggaggtcttcttgtacaagaggtgccggaacattgcttgccagagtgctctccctgctgaggagtgcagatgcaacgtgtgcgctagcaggaatggcttttgcaacctgtgcatgtgtgtcatctgcaacaagtttgattttgaggtcaatacatgccgttggattggctgtgatttttgctctcactggacacatacagattgtgcaattcacaatggccagatcggaatgggacaatcagtgaaaagcagcattggtcatgctgaaatgctttttaggtgccgagcttgtcagaggacctcagagctgctgggttgggttaaggatgtcttccaacaatgcgctcctggttgggatagggatgctttgttacgcgagcttgagttcgtttgtaagatattccgtttaagtgaggatgcaaaagggagagtgttgttcaggaaatgtctagatctgattgaaaggctgaggaacactccagctgattccatcaatcctaggatgatactacaagcactccaagagcttgagatggactcccccaagatctctgaaaatgaagatgttgggcatctgatcacaccccaggaagcctgcaaccgcatagcagaggtagtccaagaggccgtgagaaagatggagctcgtggctgaagaaaagatgcgactttacaagaaggctcgcctcgccgtggaggcctgcgaccgagagctggaggagaaggttagggaagcccaggagctgaaggcagagcgtcagcgcaagaagcagcaggtggaggagctggagagcatcgtgcggttgaagcaggcggaagcggagatgttccagctgaaggcgaacgaggcccggcaggaggcggagcgtctgcagagcattgcgctcaccaagtccaagacagccgagcaggactatgccagcatgtacctaaagcggcgcctggaggaggcggaggcagagaagcagttcctcttcgagaagatcaagctgcaggagaaccagaggccaacggtcggcgtgggcagcagcagcggtgcgggaggggactccacgccgacgatgatgctatccaagattcaggatctgctcaagaacgtccgcagcatgccagcaaagtcggagggtcactag

SEQ ID NO: 7 - DNA, 1854 bp, Zea mays
atgagcgaccgagcgtttcaaaatttgaagaccctgttagaccaggcagtcaaaccaaacccaagatctcccgtgtcccgccctcctcgccagtcgcctccctgctcctgctgccggcagtggcggtggtgtcgcctctcctcagtcctcactcctcctcaccccagcggaagcgcgggcccgactccgtccgacctcgccgtctcggccccgagggcggggagaagccggcagggtgagcccgacgctacgccacgccgcgccaccatgccgctgccgctggccaaggcgaggagggggtcctccccgcagccgtcaccgcagcccgcgcggtcctcctgcaggtcgcagctggagcaggacgtgaagaggctgcgcaaggcgctgcaggacgagacggcgctgcacgccgtgctcgagggcgccctgggccgcgccgccgtcacgctcgccgacatggcctacctccccaccaacgcgcaggagctgctctcgaccatctgcatcctcgagacggcggtcacgaagctggaggaggagatggtctccctgcatttccagctcacccaggagaggaacgagagacggctcgtcgagtaccgcctcaagcacctgcccccgccgccgtccgcttgctcctgccactccgggaaactcggaccagacgaccccacaggcgaaaaatgcagtagccaaacggaggaggtttaccctcgcgccgtcttgcatgaacaggctgtgaaactgcagaggcagatctctgtcaagagcttcgtcgatcctaaccagctttccgaggacatcgtccgctgcatgaggaacatctttatttcgctgtcagattcctgcagggactcctcaaggaactcgaacatggagaatcagcagtccattccatctcccaccgggaactattcgatttctgccttctggactctgtcggaaccgtcgtccatttcttcttgggtacagagccctcaagtggatttgaactacaacaacaatgtattagcttcggagactgtttttgacccttacaaagctcgcgagaagcttagctgggctgacataggcagctacggtgcggcggccgaagtttcgtggatgtcagttgggaaaaagcaacttgagtatgctgcggagtcacttcgtaagttcagattgttcattgagcagctggcagaaataaaccctattcacctcagtgatgatgcaaggttggcattttggatcaacttatacaatgcgttgatgatgcacgcttaccttgcttatggtgttccacggagtgacatgaaactgttttcactgatgcaaaaggctgcatacaccattgggggccactcattcagcgctgcgtttattgaatacgtaattctgaagatgaaaccaccaagccataggccacagatggctctgcttcttgccctccagaagattaaggtacccgaggagcagaaaaagttctgcattgcggcacctgagccacttctgacgtttgctctcagctgtggaatgtattcttctcccggggtgaagatttacacggctaacaacgtgagggaagaacttcaagacgcacagcgtgatttcattagagcatcggtaggagtgagtcggaaagggaagcttctggcccctaagatactgcactgctttgcccgtggctttgtcgacgacaacagcttcccaatctggatctcgcatttcctaccccagcagcaagctacgtttgtcgatcactgcgtgtctcaacggcggcaaagtctcctgggcacccgtactttcggcgtcgttccatttgattctcggtttcgctacctcttcctgccagatgcgggatcgttaaattaa

SEQ ID NO: 8 - DNA, 612 bp, Zea mays
atgctgcagaaggagcttccgcggtgcgcgtgcggcgaccggagcgccgcgccgccggccttctcgctgctgttccccaagcccatggggctgccggcggagcagtggtactgctaccacgaggagggcggcgcgtcgccgtacggcgcagccagcaccccgatcgactgcacgctgtcgctcggcacgccgtccacgcgccgggccgaatcagccggcgtcggcgtcgccgccgccttgatggaggagccccgccaaggctctccgccccggcggtgcgccaactgcgacaccacgtcgacgccgctgtggcggaacggcccgcggggacccaagtcgctgtgcaacgcctgcgggatccggtacaagaaggaggagcgccggcgacgtacgagtgcggcgggtacgctcgaccgccgcgcgccgccgcagcagcagtggggatgctacggcccgggcgcggggaagtcggcggcgtcctacgggatgtacgatggcgacgtcggcgtcgtggccgtggacgggccctgcctgtcgtggatgctcgaagtcgtaccctcctcgccggcgttcgccgcccgggagaggcgcactctgtccccgtactactag

SEQ ID NO: 9 - DNA, 2685 bp, Zea mays
atggcgagcagcagggggaggctgaggctctccccgcgcgcggcggcgccgcagctggacgcgggcaagtacgtgcggtacacggcggagcaggtggatgcgctggagcttgcctacggcgagtgccccaagcccagctcgctgcgccggcagcagctcatccgggactgcgccgtcctcaccaacgtcgagcccaggcagatcaaggtctggttccagaaccgcagatgccgggagaagcagcggagggagtcctctcgtctgcagaccgtcaaccggaagctgggtgccatgaacaagctgttgatggaggagaacgaccggctgcagaagcaggtgtcccgtctcgtcttcgacaacgggtatatgaagaatcggctccacagtccttctgtagccaccaccgacacaagctgcgagtctgtggtgacaagtggtcagcacaagcagcagcaaaacccagcagttctgcatcctccacaaagggatgcgaacaacccagcaggtctactcgctattgctgaggagacattggcggagttcatgtccaaggcgaccggaactgctgtcaactgggtgcagatggttgggatgaagcctggtccggattccgttggaatcatcgctgtttcgcacaactgcagcggcgtagcagcacgagcttgcggccttgtgagcctcgagcccacaaaggttgccgagatccttaaggatcgcgcatcgtggtatcgcgattgtcggcgtgttgatatcctccatgttatccctacgggtaacggtggaacgattgagctgatctatatgcagacttatgcactgacaactctggcggaaccgcgcgacttttggacactacgatacactagtggtcttgacgatggcagtcttgtgatctgcgaaaggtcattgacccactccactggaggtccttctggacctaaaactccagattttataagagctgaggtgcttcctagtggttatctgattcgaccttgtgatgggggaggttccatgatttacattgtggatcatgttgatctgaatgcttgtagtgtccctgaggttcttcgaccgctctatgaatctcctaagatactggcacaaaagatgactgctgcggcgttgcgtcacattaggcaaattgcacacgaatcaagtggtgaaacgccctatggtgctgggcgacagccagctgttctcagaactttcagtcaaaggctcagcagaggcttcaatgatgctgtgagtggctttccagacgatggctggtcttctttgttgagcagtgatggtgctgaggatatttcaattacaatcaactcatctccaaacaaacttattgggtctgatgtcagcccttccccattcttttctgccatggggggcggcatcatgtgcgcaaaagcgtcaatgctactgcagaatgtgccacctgctctacttgtgcgatttttgagggagcatcgctctgaatgggctgaccctggtgttgatgcttattccgctgcctctctgagggccaacccatataatgttccgggtttaagggctggtgggtttatgggcaaccaggttatactaccccttgcacgcaccgtggagcatgaagagtgcttggaggttattcgacttcaaggacatggctttagccatgacgaggttcttatgtccccggatatgtttcttctgcagttgtgcagcggcatcgatgaggatgcgccgggtgcttgtgcacagcttgtcttcgctcctatcgatgaatcttttgctgacgatgcaccgttgctaccctctggcttccgtgtgataccgcttgatgctaagacggatgtgccatctgccacacgtacccttgaccttgcttctgcgctcgaggtcggatcaggcggaggtctgtgtgctttaagcgatagcgggtcaggcacgcgcagcacgaggtcggtcctgaccatcgccttccagttctcgttcgagaaccacctccgcgagagcgtggcagcgatggccaggcagtatgtcagggcagtgatggcgatcgtgcagagggtggccatggcgatttctccctctcgccttggcccgcatgtcgaactgaagcatccgccaggctctcccgaggcactcgcactagcttcgtggattggcaggagctacagggcgcacactggaacggagatccgctggtcggacactgaagacgcggcgggctctcccctgacgctgttctggaagcacagcgacgccataatctgctgctctctaaaggtgggccagcgctgtgcatctcatgcagtcgacagtcgtcctcatgattccatcgccgcacttcctagtaactgtagcttacgccataacctgagaccgggcattgtctactgctcgcagccggctttcacactcaagttcgccaacagcgccggcttcgacatactggagacgacggtcgcgaacgtccaggacctgcagctggaggcggtccttgatgacgggggacagaaggccctggtcgcacagctccccaagatcatgctgcagggcctggcgtacctccccggcggcgtgtgcaggtcgagcatggggcggcaggcgtcgtacgagcaggcggtggcgtggaaggtggtgggcgacgacggcgcgccgcagtgcctggcgctcatgttcgtcaactggaccttcatctga

SEQ ID NO: 10 - DNA, 2811 bp, Zea mays
atggacgcgtaccagcaccagcgacgcttcgccggcgccggcgacgcaccgccgccgccgcctcacccctcccacccgagcgctcagtggtacccggcgcccccactgccataccatcctccccaccccggacacccctaccctccgcagcaccaccaccagtgggccccgccacccgacatgcagcaccagcaccatccgccgctgccgcagccctacgtgtaccaaccgccacccccgcccatggcgatgcagcaacagccgcccccgcctcctgggaacccctggccccctcaccacggcgccgggcagcacccgccgcctacctaccctcctcctccgccggggcaggcttggaccaatcactcatgggctcagaatcatggatatcaaggtcatgacaatgaggaagattgggctacaaaggctaaggcatgggttgctgctaaatctgttatgggaaaccaccagattcaacagcatgccatatccacaagtagaactgaaggtcatcataatggttaccatgatcagtatcagcaaccagctggtctgccaacagaagttacagaagctttgcacccaccagtacctcaatcaagtattgatcatgtgccatttccaatgacaggtcaacagagagaaacaaaccatttattagatagaggtccaatggtgtctccagcaaagaattttggttcattttcgtccacctatgagcaggaggtatcttataattattcttctgctccaggtactgggaataatatgcttcaatatccaaactctcaagcacagccatttccaaccacggcagctgttcaaggtggattctcacagggttgccttagtatgcctgttcccttgacagaacagcctctttttgggcatgaaagacagccaattgatccaagtgaccaacctttggaatttaacagtaggaaagctcctgatttggcagtacatataaatgtcaattccaatatcccagctcctcaaacactagcacctaatcatgatgtagctgcaacctctacacattcatggacgccatctgctacagtagggtacctgcctcgagctcctgtgccaccacaaacagcacagatggatccttctgtgcatgctgcaccactttttggagcagcatctagttctagttatgtttcacctgcagcatttggtgttggtaatgtaacagaagtgttccctacagatccaaacactccttttagtgttgcagataaatcaaagaaacctccagtacctaactggcttcgggaagaacttttaaagaaaaaatcggaaccactgagtgcttcagcgcaaaactcagaaaacttaaatcccatggaagctaatgaggcagtacagacaataggaagacctgaccaaagtgacagcagaagcaatgattccgctaaatccactgaagacgatgacgatgatgaggatgaaattgaagcagctcgaatggcagcaatcaacaaggaaattaagcgtgtgttgactgaggtccttttgaaggttactgatgagctttttgatgagatagcaacaaaagttctaaatgaagacgactcagctgaatccaatgaagccactggtgttttcggatcaaaggagactggtctgggaagatcaagagccaaggcctcggctaaagttgttctccctgctaagtcaacaaatagttctgatcataaagatagtactgggttaagttcccctaaaggtgctcttctcggcctggctagttatgattcagatgatgacgacgatgctgacactgacagcaaggataagatgccaatatcaaatttatcttctaaagataatgctggtgctgtaaatactgaaggtgataaaagcactcttggtaaaagaaatgggaatcacaatgaacagaattcttcacttggaagttctccatcaggggaagatcttaaatctaataatcaaaactttcaaaggaatgcgaatgcagaacctgaacaaatgcatattcgtgatacagagaatggggagttccgtttcaaggccaagactcgtactgagccaaagggtgcatttgacagaatggatgagaaggcacatacgtatgcagaggtagatatccagaacagaaaaacctcttttggcaataatgctgaaaagcacaatgatttggaaagcagtcacagacattcagaaaagagcagcaaagaggactttgttaatgagttgaaggctgatcatacaaaagaactcgaatattctagagcagaaaaatataataacgatgacaaatacagcatgtatggaaatattgacaaaaggggtagctgcaaggagggaaaaggttctgatagtgctgcaaagcatgaatccgatacaagggagccacattacagaggtaactctaagcttgatggtgcaaagggagattggaaggatttgccgaaggatagagagagaaatagagatgatagaagggggaaaggaaaggatgaaaaggacgacaggttaaggcagatgacaagtcataacagcagaagttcacggtcacgatcaccaagggggagaagtcgtactagaaaggagaactcacatgttcgagggagtgtttcaagtgatgagccttctgatagtgtgaaaaagagaaagcattattcccataaaaccagcatgtcaccttcacccccaaaatctagaaacagacgaatttcgcggtctccacatagcaagcattctcaccgcaggcattcgccttattcatcggctggcaggaagaggcggtcgagatcgagaactccggtcaaaaggagatag

SEQ ID NO: 11 - DNA, 3501 bp, Zea mays
atggctcgccgacgccgccgtgtcttccgcggcagggtgcccccggacctccaccgggcctacggcgcacttgcacgcactctcggccacgccgtcctctcactcatcccgccgccgacgcaggcgggcacaccctgctctgcctgccgcggacgcggaggcgccggttgcctcgcgtgccgccgctgggagtacctcctccgcgatggtgacccggtcgcgtaccgcagcctcatcacccgcgctgtctgcgccgtcgcgccgtccgggtctgcaaccccgccgccgctgtacacgccggggaatggcgggcactcacaggccaagctcgttggggtggcgatcaagttgatgatgatggatcgggcgtgtacaacaacgaacgtcctctccagcggttgccgtgcgattggggatttactcatgtgctatattctaaggcattcatcaatatttttgcctgttaagaagaatgttttttttcaagtaactggcctcccgctcaatgatttcctgcaaaagcctatgtttgcgagtgcggcaaagaatcaacaaccccaatccacgaaaggaaaatacttgtgctatctgtgccagaacccagagaggtcacaaatcatttatggaggctatgccaataattccaaagttgcatgttcagaacttcctttgactaatggaccaataaagtgttccaatttagacaatcaaaattctaggaaaagaaaaaggctgtacaaatggcaacgcctcaaaaaacagaagcagatttttcctagttccgaggacaaatcattaactagtcagagtgaaataagcaccaatgggtttggtgtccatgatgttttattggaggacttatgtgctacagtgaaggataaatcacagtttttggaaccgacagtagataatgattccttagcaatgaatattagaacttcccagtgtaacagtacatcaagaattcaatctacatccccgcaagttggacttcccaatttcatgcatctcaataatggtctcatctgcttcaattgcttaatgttgaattcctccaaacgtgtctcagtagatttgcttatatcaagacatactatcttctacaatagaaagacttcctataacgtcttccatggcaaccacatattaaacaaaaggaaaataccagatgcattatcacttataatacatatatttggattcaagggatgctgcgcaaagttattgaaatgcaactgccatgtgtctactacaacaaattctaattgcatgtgtctttcgctgcctaaactaatgaataagctcatcagaaattctaagcgctgccagtataggaaactatttctgaagcattgtcctgtcaattccaagtgtgcagctgatgttgccaagaaccataataacaaggcacactttttaattggaggaaaatcggcatactatgatcagtcttatgttcaattggaggcttacagtacacatcaacaagtagtttcattcatctgggcagtgttgacacgaattatacctgagccgttgcttggaaactctagcagcaagagatctttaaggataaacatttggaaatttataaagttgcgtaggtttgaatcattttgcttgagcgattgtattggtgagctgaaagtatcacattattcttggttatcaaatattggattttctgattgcttttgctctgctctaatggagaaagaaatttggtcatcaaatggttccgaggaggagaaacttcaaaatcttctgcgttgttggattagttggatgttttctgatatagtgataccattagtccagtcatatttttatgttacagaaagggaatctaggcgatatgatgttttatattatccaaagacagtttggagaaacttgactagtacagctattgcttccctaaacagacaaaacttcaggattttgcgtggtacatccaggaaagaagcaatccagtcatgctatttttcaacagtgaggttcattccaaaagcaaaagatatgagaccattagtaaatctcagagctcaatcaaaaaatgccctcctcaataattgtcacctgattataaacaaagtaaaggatgagaatccagacaagtttggttcttctgtttttgattacaataatgtgcatcaaaatatctggcattttatttcttcagtaagaagtcacctgaaggaaaaaataaagatatatatagttgttgccgatgtatcgaaggcattcgattgcattactcatgatatgttactgaaagttgtggatgatgcattgaaatgtgatgactatgttctgaggaaatgcaaaaaagtagtttgcaactggtctaagaatgccatctaccgtttcgattcaaatgtttctatcagcaacggtgataatgtatgtgattttttgattcagttatcatcaaggggtggcattttagtcgaccagggaaaaagttgcaagatacggaagaaagagattcaatgtttcctttccaagcaagtgaagtgcaacattttgaagattgggcaaaacttctactcacaacgagtaggcatcattcaaggaaacaagttatctcccaacctttgttccctgtactttggtcaccttgaaaattctgagctattgaaatctcttcatgataacaagattgattcagaaaaggatgttttaacacctagaagtttattaatgaggttcattgacgatttcatattcatatctttctccaaggagcaagctctaaatttcttcaataggatgagaagagggtttgtcaactacaactgctacatgaatgacagcaaatatggtttcaacttcgaggttgcaaacagtgaacattgtagtaataggatctacaagggtgatgatggattctctttcataccatggagtggcttgcttataaattgtgaaactttggaaattcaagctgattatacaaggtatctggacatccatatttcctccaccatcactgctaagatgcattcttcagcgaagtaccttgagagcaagctgtgtcattacatgcgtccgaagtgtcatcccattttctttgattctgtgatcaactcaccaggcacagtaagactgaacatatatcaaaatttcctcttatgcgcaatgaagtttcactgttatttccggagcatgcctgatcccggtatcatgaaaccggagctactgcatataattaagagaacgttcagatatatgcatagcctcgtcgccaaacggatgcacgaagcggaactgcaatacgacgtgcgcccagttctgaagcttaggcgaaaggaaaccatgtggcttggcctgtcagcgtaccttcgagtgcttcagaaaaagcaatcacgttacagtgaattgttggcgtcgctgagagaagaaattgggagatgtggtcatctggaccgtcacaacgatgctttgcgctacgctgtagatgactctcactcgtcagtgttctggaagtttaagttctag

SEQ ID NO: 12 - DNA, 501 bp, Zea mays
atggagcagagccagggacagggagggaggaggcggcagatcccggcgttcgggaggtggaaccagcacagcgtcggcgacgaggtgcccatcacgcagtacttcgagtcggcagtacaggccagcctcctcgccaggcccggccactgctaccacgacgccggcgccggcgaggtgctgctgttccggtcgtccgcctcgccgcctccgcacaagccgcccaagaaggtgcggagcacgacggagtgtcacggtcaccaccagcaggttcaggttgaggaggtggggagcaggaggaggcagcagcagcggcggcggcaggagccgttgccgccgttcgtgtccggcgacgtgtcccgcgcggcgaggccgagggtcgttagggcggcggtggacgaggacctgtacaaggtcccttccgatatgctacgcaagaagaaagggaggaagcatgtgaggagcgtgtggatgggctgcgtgggcctcacctgcgtcgcctga

SEQ ID NO: 13 - DNA, 1656 bp, Zea mays
atggcgtacatgtgcgcggacagcggcaacctcatggccatcgcgcagcaggtgattcagcagcagcagcagcaacagcagcaccagaggcaccaccaccacctgccgccgctcccgctcccgctcccgccgcgccaggcgccgccgatgccgccggccccggccccggcttccccgcacggccagatcccggcggcatccctaccgtacggcggcggcgcgtggtcccaggcggaccatttcttccctgacgccttcgtcggaacgtccccggccgacgcggtgttcccggacctctccgccgccgcggacttcgactccgatgtgtggatggacagcctcatcggggacgcaccggtcttcgcggactccgacctcgagcgcctcatcttcaccaccccgccgccgcccgtcgacgcggcggcccagcccgagtccgccactcgcgcgtcgcttccccagcctgccgccgtcgcaacggcggcagcgtgttcctctccgagctccttggacgcctcctgctccgcgcccatcctccagtccctcctcgcctgctcccgtacagcggccgctgacccagggctcgcggccgtagagctcgtcaaggtgcgtgctgccgcctccgaagatggggaccccgcggagcgcgtggcgttctacttcggggacgcgctggcgcgccgcctggcctgcggcggcggggcgcaagcgcaacccttgacggcggtggacgcgcgcttcgccaccgacgagctcacgctctgctacaagacactcaatgacgcctgcccctactccaagttcgcgcacctgaccgccaaccaggccatcctggaggctacgggcacggcgaccaagatccatatcgttgacttcgggatcgtgcagggtatccaatgggcggcgctgctccaggcgctcgccactcgcccaggggagaagccgtcccgagtgcgtatctccggtttaccctcgccgtacttggggccaaagccagcgacgtccctcgccgcaaccagtgcccgtctccgcgacttcgcaaagcttctcggggtggagttcgagtttgtcccattgctgcggtcagtgcacgagctggatcggtcggatttcttggttgagcctgacgagactgtagccgtcaatttcatgctccagttgtaccaccttcttggcgactccgatgagcccgtgcggcgagtcctccggctggttaagtcactcgatccatcagtcgtcacccttggcgagtatgaggtcagtctgaaccgagctgggttcgtcgaccggttttccaatgcactgttgtattacaagccagtgttcgagtcacttgatgtggcgatgccacgggactcaccggagagggtgagggtggagcgatgcatgtttggggagcgcattagaagggccattgggccagaggaaggcgctgagaggaccgataggatggcggctagtagggagtggcagacgctgatggagtggtgtggctttgaacccgtcaaactcagcaactacgccatgagccaggctgatcttttgctttggaattacgattcgaagtacaagtattcgcttgttgagctaccaccagcgttcttatctctggcttgggagaagcggccgctgctcaccgtgtctgcttggcggtga

SEQ ID NO: 14 - DNA, 1530 bp, Zea mays
atggcggcggagcaggggcggtcgctggcggagacgcccacctggtccgtggcaaccgtcaccacgctcatggtcgctgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagccagacggcgcgcttcatatcggagatctgcgtgccgtcctcgctcttcaccagccgcttctacatctgctccgagagcgactaccaggacctgctgcgcaacacggacgccaaccagacggcgctcgacaagaacatgttcggtggccaacggctgcacgtctgtggcgagggccatgaaccttttgtttcgtacgagggccttgagcagctgcaccggtttctcttcatccttggtatcactcatgtgttgtacagttttgtaacagtggttctgtccatgatcaagatctatagctggaggaagtgggaaaccttagcaggtccaattgctgctgaggaattgaaagctaggagaaccaaggtgatgagaaggcagtcaacctttgtttttaacaatgcttctcatccatggagcaaaaataaaatacttatttggatgctttgctttttgcgtcaattcaagggctccataataaggtcagactatttggcactgaggttgggctttgtcacatatcacaagctaccacattcatatgacttccataaatacatggtacggagcatggaagatgattacaatgggactattggtatcagttggccactttgggcatatgcgattgtctgcatattaatcaatgttcatggtatcaatatatatttctggttgtcctttgttcctgttattctggtgcttctagtgggtactgaacttcagcacgtcattgctcagttggctttggaagtcgctgaggcaacagcgccttatgttggctcacaacttaaactgcgtgatgatctattttggtttggaaagcctcgggtactctggtggcttatacagttcatttcatttcagaatgcttttgagctggcaacattcttatggtctctgtgggaactcagtgcacaaacatgtttcatgaagcactactacatggttgccattcggttgatttctgggctcctagttcagttttggtgcagctacagcacactgccgctgaatgtgattatttctcagatgggttccaagttcaagaaatcactggtctcggagaacgtgagggagtcgctgcacagctggtgcaagagggttaaggacaggagccgacacaatccgctcttctcgcggaacgggaccctcacgaccagatccgtgtgctccctagacaccacctacgagacggatcacgagacgaacacggtgtgcacgctgtcgaggacggcgtcggcgacgtcgctggacgaccagttgaccgtggtcaccgtcgatgacgagccgtcctgcattgagaaggatgtctga

SEQ ID NO: 15 - DNA, 1488 bp, Zea mays
atggcggtgatgagccgccgccgcgtcatccagctcgtcctcgttggcgtcgtcgtcttcctggtggccccgcggctgtcgtggaaccttccgggcggcctcgagaagctggggctgcagcagagcccggcggcggtggcggtggcctgctgggcggctgcggtggcggcgtgggcgtacgcggtgtcccggccccggcccgtgtacctggtggacctgtccgggtacgtggcgggcgcgtcgcacgaggcgtcccgcgccaagacgatcgcccacttcgggcggtgcgggcggttcagcgacgagagcatggcgttccagaagcggatgctggagcggtcggggctcggggagcagacccacttcccggcgtcgctgatcagcgtgcccgtggacatgtgcctccgcacggcgcgggaggagtcccacgccgtcatcttcggcgtcgtggacgacctcctccgcagggcgcgcgtggcgggcggcgacgtcggcgtgctcatcttcaactccagcctgctcagccccacgccgtccttcacgtcgctcatcgccaaccgctacgggatgcggcgcgacgtcgtcagccacaacctcagcggaatgggatgcagcgccggcatcatcgccatcgacctcgccaagcgcctgctacaggtgcactcggacacgtacgcgctggtggtgagcacggagaacatcactctcaacgcctacatgggcaacaaccgccccatgctggtcaccaacacgctcttccgcgtcggcggcgcggccatcctgctgtccaaccgccgcgccgaccgccgccgcgccaagtaccagctcatccacacggtgcgcacgcaccgcggcgcgcacgaccagagcttcggctgcgtcacgcaggaggaggacgacgcggggtgcgtcggcgtctccctggccaaggagctcatggtggtcgccggcgaggccctgcgcaccaacatcaccacgctgggcccgctcgtcctgcccatgtccgagcagctccgcttcctggccaccgtcgtcctcaaccgcgtcttccgcgccagagtgcgcgcctacctgccggacttcaagctcgccttcgaccacttctgcatccacgccggcggccgcggcgtgctggacgagctggagcgcagcctcaacctcagcgcctggcacatggagccctccaggatgacgctctgccgcttcggcaacacctccagcagctcgctctggtacgagctcgcctactgcgaggccaagggacggatccgcaagggggaccgggtatggcagatcgctttcggctccggcttcaagtgcaacagcgccgtctggaaggcgctccgcacggtggacggcggcgaggagggaaacccgtggacgccggagatagacgtgctccccatccacgtgcccaaggtttcgcccatcgatgagaccacctacaagttcgctgacggcgccacgtacaagatctctcttggttaa

SEQ ID NO: 16 - DNA, 312 bp, Zea mays
atgcacgggagaaccgccatggcagtggcctgccttctgtgcatgacggctctgctgctagtccaggatgtccagtccaggaggctactgtggacggagcaggagaagaaacaaacccatggtggcctcgttggcaaccatggcaccgctgaccggcgaagcacctccctggaaccgtgcagtggcgctatgggaggaggcggcacaggaagtgcagacaagcagggcgaattcccgtgtgatgatgatacgtcaaaatggacagaactgcacacggattacatatacacccaagacttcaagcacccataa

SEQ ID NO: 17 - protein, 348 aa, Zea mays
MWDGGVEHGSQEAAHQLLPWLGAAPFSEPAAVAGLGAAMGAYACDGVGGLGHGGVFGFGFDAAVQQQQQQQRAADGSGKAVVVSGLLGSLQAELGRMTAREMMDAKALAASRSHSEAERRRRQRINGHLARLRSLLPNTTKTDKASLLAEVLDHVKELKRQTSAMMAATDADADADDEGAGRTQAQAQAQLLPTEADELCVDAGADGAGRLVVRASLCCEDRPDLIPDIVRALAALQMRARRAEITTLGGRVRSLLLITADRRADVQRGGGGGGGDGDDDEEEEDEEEGGERAASHRRHECIASVQEALRGVMDRRTASSCDTSSSGGGGGSIKRQRMNYGAQEQCSV

SEQ ID NO: 18 - protein, 355 aa, Zea mays
MVPGYDCAASVLLCAEDNAAVLGLDDESSWAAAATPPRDTVVAAAAAGVAVDGFLTEFPLLSDDCVAALVEKEVEHMPAEGYLQKLQRRHGDLDLAAVRKDAVDWIWKVIEHYSFAPLTAVLSVNYLDRFLSTYDFPEGRAWMTQLLAVACLSLASKIEETFVPLPLDLQVAEAKFVFEGRTIKRMELLVLRTLKWRMHAVTACSFVEYFLHKLSDHGAPSLLARSRSSDLVLSTAKGAEFVVFRPSEIAASVALAAIGECSSSVIERAATSCNYLDKERVLRCHEMIQEKIAVGSIVLKSAGSSISSVPRSPIGVLDAAACLSQQSDDATVGSPAVCYHSSSTSKRRRITRRLL

SEQ ID NO: 19 - protein, 404 aa, Zea mays
MKGTPYWMAPEVIVGSGHSFSADIWSVGCTVIEMATGKPPWSQQYQEVALLFHVGTTKSHPPIPEHLSPEAKDFLLKCLQKEPELRSTAPDLLKHPFVTGELDDLQPLNHAARKNSFNEIPSDDMPNGLGLNKSSNWSTMNSSKSSKIKPLWEGGCDDDDMCEFADKDDYAGVGSSYNPMSEPFDNWENKFDISPEQNSHQPMEFGELAKHVESSITGNDFTFPVGGSCEDDDVLTESKIKAFLEEKALDLKKLQTPLYEEFYNTVHGGSFQGADQTSKGKLPISPKFPPRGKSPPCKTRVGACDTSNDTAPESCSKQFPRSSVVDSSRILREIASPQLNEFADKIHLDAQDSPSISFTERQRKWKEELDQELERERVLRLAGCGKAPSPNRGSNVKKEYHADH

SEQ ID NO: 20 - protein, 123 aa, Zea mays
MAAPKLATLALAVLLAATVVAPPAAVRAAMSCSTVYSTLMPCLPFVQMGGAMPPQPCCGGIRSLLQQANNTPDRRTICGCLKNVANGANGSGTYISRAAALPSKCGVALPYKISTNVNCNTIN

SEQ ID NO: 21 - protein, 355 aa, Zea mays
MAPSSYEVAASILLCAEDSSSILDLEAEAEEEALLARSGEPGGGAEFPVPSEECVAGFLESEAAHMPREDYAERLRSGGMDLRVRTDAIDWIWKVHTCYGFGPLTACLAVNYLDRFLSLYQLPEGKAWMTQLLSVACLSLAAKMEETYVPSSLDLQAGDARYVFEAKTIQRMELLVLSTLKWRMQAVTPLSYVDYFLHRLRGGAAPSRRAVLRSAELILCIARGTHCLDFRPSEIALAVAATVAGEERAVDIDRAFTHRVHKERVSRCLEAIQQATATMALPQPLKSEGPSSSGRRASSSSATVPRSPTGVLDAGCLSYRRAAAAAASHASSSWRDEDDDDCPPAVCSKRRKISR

SEQ ID NO: 22 - protein, 593 aa, Zea mays
MGTSSGANFHQQPPPTQGMLPPRHGPRPSGLQTSLSLASSEQVGSPDMQEPGSNSEPGHDSATESASSKDTWPAEPNQSNGGVAASDVVSKAAEKEVANGVSKPQVIHGPSSRMSGMLLREVARERVDLVAEKMKMMSDEHLEEVKNELRSILEGTGGSHHIEEFLYLQKLVQDRHDLTPSMLSVAHHVQLEILVAIKTGIQAFLHPSVTIPHNRLVEVFLYKRCRNIACQSALPAEECRCNVCASRNGFCNLCMCVICNKFDFEVNTCRWIGCDFCSHWTHTDCAIHNGQIGMGQSVKSSIGHAEMLFRCRACQRTSELLGWVKDVFQQCAPGWDRDALLRELEFVCKIFRLSEDAKGRVLFRKCLDLIERLRNTPADSINPRMILQALQELEMDSPKISENEDVGHLITPQEACNRIAEVVQEAVRKMELVAEEKMRLYKKARLAVEACDRELEEKVREAQELKAERQRKKQQVEELESIVRLKQAEAEMFQLKANEARQEAERLQSIALTKSKTAEQDYASMYLKRRLEEAEAEKQFLFEKIKLQENQRPTVGVGSSSGAGGDSTPTMMLSKIQDLLKNVRSMPAKSEGH

SEQ ID NO: 23 - protein, 617 aa, Zea mays
MSDRAFQNLKTLLDQAVKPNPRSPVSRPPRQSPPCSCCRQWRWCRLSSVLTPPHPSGSAGPTPSDLAVSAPRAGRSRQGEPDATPRRATMPLPLAKARRGSSPQPSPQPARSSCRSQLEQDVKRLRKALQDETALHAVLEGALGRAAVTLADMAYLPTNAQELLSTICILETAVTKLEEEMVSLHFQLTQERNERRLVEYRLKHLPPPPSACSCHSGKLGPDDPTGEKCSSQTEEVYPRAVLHEQAVKLQRQISVKSFVDPNQLSEDIVRCMRNIFISLSDSCRDSSRNSNMENQQSIPSPTGNYSISAFWTLSEPSSISSWVQSPQVDLNYNNNVLASETVFDPYKAREKLSWADIGSYGAAAEVSWMSVGKKQLEYAAESLRKFRLFIEQLAEINPIHLSDDARLAFWINLYNALMMHAYLAYGVPRSDMKLFSLMQKAAYTIGGHSFSAAFIEYVILKMKPPSHRPQMALLLALQKIKVPEEQKKFCIAAPEPLLTFALSCGMYSSPGVKIYTANNVREELQDAQRDFIRASVGVSRKGKLLAPKILHCFARGFVDDNSFPIWISHFLPQQQATFVDHCVSQRRQSLLGTRTFGVVPFDSRFRYLFLPDAGSLN

SEQ ID NO: 24 - protein, 203 aa, Zea mays
MLQKELPRCACGDRSAAPPAFSLLFPKPMGLPAEQWYCYHEEGGASPYGAASTPIDCTLSLGTPSTRRAESAGVGVAAALMEEPRQGSPPRRCANCDTTSTPLWRNGPRGPKSLCNACGIRYKKEERRRRTSAAGTLDRRAPPQQQWGCYGPGAGKSAASYGMYDGDVGVVAVDGPCLSWMLEVVPSSPAFAARERRTLSPYY

SEQ ID NO: 25 - protein, 894 aa, Zea mays
MASSRGRLRLSPRAAAPQLDAGKYVRYTAEQVDALELAYGECPKPSSLRRQQLIRDCAVLTNVEPRQIKVWFQNRRCREKQRRESSRLQTVNRKLGAMNKLLMEENDRLQKQVSRLVFDNGYMKNRLHSPSVATTDTSCESVVTSGQHKQQQNPAVLHPPQRDANNPAGLLAIAEETLAEFMSKATGTAVNWVQMVGMKPGPDSVGIIAVSHNCSGVAARACGLVSLEPTKVAEILKDRASWYRDCRRVDILHVIPTGNGGTIELIYMQTYALTTLAEPRDFWTLRYTSGLDDGSLVICERSLTHSTGGPSGPKTPDFIRAEVLPSGYLIRPCDGGGSMIYIVDHVDLNACSVPEVLRPLYESPKILAQKMTAAALRHIRQIAHESSGETPYGAGRQPAVLRTFSQRLSRGFNDAVSGFPDDGWSSLLSSDGAEDISITINSSPNKLIGSDVSPSPFFSAMGGGIMCAKASMLLQNVPPALLVRFLREHRSEWADPGVDAYSAASLRANPYNVPGLRAGGFMGNQVILPLARTVEHEECLEVIRLQGHGFSHDEVLMSPDMFLLQLCSGIDEDAPGACAQLVFAPIDESFADDAPLLPSGFRVIPLDAKTDVPSATRTLDLASALEVGSGGGLCALSDSGSGTRSTRSVLTIAFQFSFENHLRESVAAMARQYVRAVMAIVQRVAMAISPSRLGPHVELKHPPGSPEALALASWIGRSYRAHTGTEIRWSDTEDAAGSPLTLFWKHSDAIICCSLKVGQRCASHAVDSRPHDSIAALPSNCSLRHNLRPGIVYCSQPAFTLKFANSAGFDILETTVANVQDLQLEAVLDDGGQKALVAQLPKIMLQGLAYLPGGVCRSSMGRQASYEQAVAWKVVGDDGAPQCLALMFVNWTFI

SEQ ID NO: 26 - protein, 936 aa, Zea mays
MDAYQHQRRFAGAGDAPPPPPHPSHPSAQWYPAPPLPYHPPHPGHPYPPQHHHQWAPPPDMQHQHHPPLPQPYVYQPPPPPMAMQQQPPPPPGNPWPPHHGAGQHPPPTYPPPPPGQAWTNHSWAQNHGYQGHDNEEDWATKAKAWVAAKSVMGNHQIQQHAISTSRTEGHHNGYHDQYQQPAGLPTEVTEALHPPVPQSSIDHVPFPMTGQQRETNHLLDRGPMVSPAKNFGSFSSTYEQEVSYNYSSAPGTGNNMLQYPNSQAQPFPTTAAVQGGFSQGCLSMPVPLTEQPLFGHERQPIDPSDQPLEFNSRKAPDLAVHINVNSNIPAPQTLAPNHDVAATSTHSWTPSATVGYLPRAPVPPQTAQMDPSVHAAPLFGAASSSSYVSPAAFGVGNVTEVFPTDPNTPFSVADKSKKPPVPNWLREELLKKKSEPLSASAQNSENLNPMEANEAVQTIGRPDQSDSRSNDSAKSTEDDDDDEDEIEAARMAAINKEIKRVLTEVLLKVTDELFDEIATKVLNEDDSAESNEATGVFGSKETGLGRSRAKASAKVVLPAKSTNSSDHKDSTGLSSPKGALLGLASYDSDDDDDADTDSKDKMPISNLSSKDNAGAVNTEGDKSTLGKRNGNHNEQNSSLGSSPSGEDLKSNNQNFQRNANAEPEQMHIRDTENGEFRFKAKTRTEPKGAFDRMDEKAHTYAEVDIQNRKTSFGNNAEKHNDLESSHRHSEKSSKEDFVNELKADHTKELEYSRAEKYNNDDKYSMYGNIDKRGSCKEGKGSDSAAKHESDTREPHYRGNSKLDGAKGDWKDLPKDRERNRDDRRGKGKDEKDDRLRQMTSHNSRSSRSRSPRGRSRTRKENSHVRGSVSSDEPSDSVKKRKHYSHKTSMSPSPPKSRNRRISRSPHSKHSHRRHSPYSSAGRKRRSRSRTPVKRR

SEQ ID NO: 27 - protein, 1166 aa, Zea mays
MARRRRRVFRGRVPPDLHRAYGALARTLGHAVLSLIPPPTQAGTPCSACRGRGGAGCLACRRWEYLLRDGDPVAYRSLITRAVCAVAPSGSATPPPLYTPGNGGHSQAKLVGVAIKLMMMDRACTTTNVLSSGCRAIGDLLMCYILRHSSIFLPVKKNVFFQVTGLPLNDFLQKPMFASAAKNQQPQSTKGKYLCYLCQNPERSQIIYGGYANNSKVACSELPLTNGPIKCSNLDNQNSRKRKRLYKWQRLKKQKQIFPSSEDKSLTSQSEISTNGFGVHDVLLEDLCATVKDKSQFLEPTVDNDSLAMNIRTSQCNSTSRIQSTSPQVGLPNFMHLNNGLICFNCLMLNSSKRVSVDLLISRHTIFYNRKTSYNVFHGNHILNKRKIPDALSLIIHIFGFKGCCAKLLKCNCHVSTTTNSNCMCLSLPKLMNKLIRNSKRCQYRKLFLKHCPVNSKCAADVAKNHNNKAHFLIGGKSAYYDQSYVQLEAYSTHQQVVSFIWAVLTRIIPEPLLGNSSSKRSLRINIWKFIKLRRFESFCLSDCIGELKVSHYSWLSNIGFSDCFCSALMEKEIWSSNGSEEEKLQNLLRCWISWMFSDIVIPLVQSYFYVTERESRRYDVLYYPKTVWRNLTSTAIASLNRQNFRILRGTSRKEAIQSCYFSTVRFIPKAKDMRPLVNLRAQSKNALLNNCHLIINKVKDENPDKFGSSVFDYNNVHQNIWHFISSVRSHLKEKIKIYIVVADVSKAFDCITHDMLLKVVDDALKCDDYVLRKCKKVVCNWSKNAIYRFDSNVSISNGDNVCDFLIQLSSRGGILVDQGKSCKIRKKEIQCFLSKQVKCNILKIGQNFYSQRVGIIQGNKLSPNLCSLYFGHLENSELLKSLHDNKIDSEKDVLTPRSLLMRFIDDFIFISFSKEQALNFFNRMRRGFVNYNCYMNDSKYGFNFEVANSEHCSNRIYKGDDGFSFIPWSGLLINCETLEIQADYTRYLDIHISSTITAKMHSSAKYLESKLCHYMRPKCHPIFFDSVINSPGTVRLNIYQNFLLCAMKFHCYFRSMPDPGIMKPELLHIIKRTFRYMHSLVAKRMHEAELQYDVRPVLKLRRKETMWLGLSAYLRVLQKKQSRYSELLASLREEIGRCGHLDRHNDALRYAVDDSHSSVFWKFKF

SEQ ID NO: 28 - protein, 166 aa, Zea mays
MEQSQGQGGRRRQIPAFGRWNQHSVGDEVPITQYFESAVQASLLARPGHCYHDAGAGEVLLFRSSASPPPHKPPKKVRSTTECHGHHQQVQVEEVGSRRRQQQRRRQEPLPPFVSGDVSRAARPRVVRAAVDEDLYKVPSDMLRKKKGRKHVRSVWMGCVGLTCVA

SEQ ID NO: 29 - protein, 551 aa, Zea mays
MAYMCADSGNLMAIAQQVIQQQQQQQQHQRHHHHLPPLPLPLPPRQAPPMPPAPAPASPHGQIPAASLPYGGGAWSQADHFFPDAFVGTSPADAVFPDLSAAADFDSDVWMDSLIGDAPVFADSDLERLIFTTPPPPVDAAAQPESATRASLPQPAAVATAAACSSPSSLDASCSAPILQSLLACSRTAAADPGLAAVELVKVRAAASEDGDPAERVAFYFGDALARRLACGGGAQAQPLTAVDARFATDELTLCYKTLNDACPYSKFAHLTANQAILEATGTATKIHIVDFGIVQGIQWAALLQALATRPGEKPSRVRISGLPSPYLGPKPATSLAATSARLRDFAKLLGVEFEFVPLLRSVHELDRSDFLVEPDETVAVNFMLQLYHLLGDSDEPVRRVLRLVKSLDPSVVTLGEYEVSLNRAGFVDRFSNALLYYKPVFESLDVAMPRDSPERVRVERCMFGERIRRAIGPEEGAERTDRMAASREWQTLMEWCGFEPVKLSNYAMSQADLLLWNYDSKYKYSLVELPPAFLSLAWEKRPLLTVSAWR

SEQ ID NO: 30 - protein, 509 aa, Zea mays
MAAEQGRSLAETPTWSVATVTTLMVAACFLVERSLSRFAKWLRKTKRKAMLAALEKIREELMLLGVISLLLSQTARFISEICVPSSLFTSRFYICSESDYQDLLRNTDANQTALDKNMFGGQRLHVCGEGHEPFVSYEGLEQLHRFLFILGITHVLYSFVTVVLSMIKIYSWRKWETLAGPIAAEELKARRTKVMRRQSTFVFNNASHPWSKNKILIWMLCFLRQFKGSIIRSDYLALRLGFVTYHKLPHSYDFHKYMVRSMEDDYNGTIGISWPLWAYAIVCILINVHGINIYFWLSFVPVILVLLVGTELQHVIAQLALEVAEATAPYVGSQLKLRDDLFWFGKPRVLWWLIQFISFQNAFELATFLWSLWELSAQTCFMKHYYMVAIRLISGLLVQFWCSYSTLPLNVIISQMGSKFKKSLVSENVRESLHSWCKRVKDRSRHNPLFSRNGTLTTRSVCSLDTTYETDHETNTVCTLSRTASATSLDDQLTVVTVDDEPSCIEKDV

SEQ ID NO: 31 - protein, 495 aa, Zea mays
MAVMSRRRVIQLVLVGVVVFLVAPRLSWNLPGGLEKLGLQQSPAAVAVACWAAAVAAWAYAVSRPRPVYLVDLSGYVAGASHEASRAKTIAHFGRCGRFSDESMAFQKRMLERSGLGEQTHFPASLISVPVDMCLRTAREESHAVIFGVVDDLLRRARVAGGDVGVLIFNSSLLSPTPSFTSLIANRYGMRRDVVSHNLSGMGCSAGIIAIDLAKRLLQVHSDTYALVVSTENITLNAYMGNNRPMLVTNTLFRVGGAAILLSNRRADRRRAKYQLIHTVRTHRGAHDQSFGCVTQEEDDAGCVGVSLAKELMVVAGEALRTNITTLGPLVLPMSEQLRFLATVVLNRVFRARVRAYLPDFKLAFDHFCIHAGGRGVLDELERSLNLSAWHMEPSRMTLCRFGNTSSSSLWYELAYCEAKGRIRKGDRVWQIAFGSGFKCNSAVWKALRTVDGGEEGNPWTPEIDVLPIHVPKVSPIDETTYKFADGATYKISLG

SEQ ID NO: 32 - protein, 103 aa, Zea mays
MHGRTAMAVACLLCMTALLLVQDVQSRRLLWTEQEKKQTHGGLVGNHGTADRRSTSLEPCSGAMGGGGTGSADKQGEFPCDDDTSKWTELHTDYIYTQDFKHP

SEQ ID NO: 33 - DNA, 1062 bp, Zea mays
ccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaac

SEQ ID NO: 34 - DNA, 881 bp, Oryza sativa
tgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcacc

SEQ ID NO: 35 - DNA, 1708 bp, Artificial Sequence
  NOS PRO::ZM-WUS2::PINII TERM
acactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcg

SEQ ID NO: 36 - DNA, 3022 bp, Artificial Sequence
  UBIZM PRO:: UBIZM 5UTR::DS-RED2::PINII TERM
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 37 - DNA, 15458 bp, Artificial Sequence
  RV010564
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagaatggcccggaccgggttaccgaattcgagctcggtaccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgggatccgatatcgatgggccctggccgaagcttggtcacccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgacgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctct

SEQ ID NO: 38 - DNA, 37174 bp, Artificial Sequence
  WUS + DZ470
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggcgcgccatttaaatatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaatttaaatgcccgggcgatcgctcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccagcttcaagtttgtacaaaaaagcaggctccggccagaatggcccggaccgggttaccgaattcgagctcggtaccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgggatccgatatcgatgggccctggccgaagcttggtcacccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggcgcgccatttaaatatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaatttaaatgcccgggcgatcgctcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccagcttcaagtttgtacaaaaaagcaggctccggccagaatggcccggaccgggttaccgaattcgagctcggtaccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgggatccgatatcgatgggccctggccgaagcttggtcacccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 39 - DNA, 21457 bp, Artificial Sequence
  WUS + DZ470 + CDKA1
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggcgcgccatttaaatatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaatttaaatgcccgggcgatcgctcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggatccatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgaggtaccgtcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccagcttcaagtttgtacaaaaaagcaggctccggccagaatggcccggaccgggttaccgaattcgagctcggtaccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgggatccgatatcgatgggccctggccgaagcttggtcacccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 40 - DNA, 21444 bp, Artificial Sequence
  WUS + DZ470 + CDKA3
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggcgcgccatttaaatatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaatttaaatgcccgggcgatcgctcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggatccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagtcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccagcttcaagtttgtacaaaaaagcaggctccggccagaatggcccggaccgggttaccgaattcgagctcggtaccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgggatccgatatcgatgggccctggccgaagcttggtcacccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 41 - DNA, 18319 bp, Artificial Sequence
  BBM alone
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgacgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 42 - DNA, 21342 bp, Artificial Sequence
  BBM+DZ470
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggcgcgccatttaaatatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaatttaaatgcccgggcgatcgctcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccagcttcaagtttgtacaaaaaagcaggctccggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 43 - DNA, 24212 bp, Artificial Sequence
  BBM+DZ470+CDKA1
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggcgcgccatttaaatatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaatttaaatgcccgggcgatcgctcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggatccatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgaggtaccgtcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccagcttcaagtttgtacaaaaaagcaggctccggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 44 - DNA, 24199 bp, Artificial Sequence
  BBM+DZ470+CDKA3
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggcgcgccatttaaatatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaatttaaatgcccgggcgatcgctcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaaccctaggatccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagtcgaggcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggtccgggcctagaaggccagcttcaagtttgtacaaaaaagcaggctccggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 45 - DNA, 20042 bp, Artificial Sequence
  WUS+BBM
aacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgggatccgatatcgatgggccctggccgaagcttggtcacccggtccgggcctagaaggccgatctcccgggcacccagctttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttaactcacttaagatgtactcgacaatggtgccctcataccggcatgtgtttcctagaaataatcaatatattgattgagatttatctcgatatatttctgaactatgttcatcatataaataactgaaaacatcaaatcgtaattttaaactcatgcttggtcaatacatagataatacaatattacttcatcatcccaatgatgtcctagcacaacctattgaatgttaatgtttggttgtgtgggggtgtgtttataacatagatgtgattatttgtgctttttgttgagtatatacatatatggtatgttgatttgatatagtgatggacacatgctttggccttggatattcaaatcacttgtacttgcacgaagcaaaacataatataagtttagaagtaaacttgtaactgtgtccaaacatgctcacacaaagtcatatcgcattatatttttttggtaaatattcaacacatgtattttttacaagaacccaaattttacagacaaatgcagcattgtagacatgtagaattctttgaagcatgtgaacttaacaacactaatgtcattaaatcaactggaccctatgagtaacaatttcgatattgcaaacaccaaattatggaacttatttgctgaaaaaattatgatcaatgtgaagtttaaattattataccataaatatatcaaagattttttttgaggaaggtaaaaattgcatggaatgggctgcccaacgtgatagctcacttttatgctaggtagcattaccaaagatgggaatgttctgatgaacaccaaacccactcaaataatatttatatttgggttgtttagttgtaaaagtgaagacccaagattaaagtaccaattgtcgatgccatacactagaagtgaagaatgttgttagcgttaggagtagatgtgtcaatggggaccgatactcgttatcgatgggccgcacgtaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagcgaagttcctattccgaagttcctattctctagaaagtataggaacttcagatccaccgggatccccgatcatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggggtggaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctaggcttaggctactgctagtccgcggtgtatccgtgatcgagttggcgccagacggaatctgttctccatcgctgacatcctcgagtagatcacattcaagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaattt

SEQ ID NO: 46 - DNA, 18 bp, Artificial Sequence
  His6 tag
catcatcaccatcaccat

SEQ ID NO: 47 - protein, 6 aa, Artificial Sequence
  His6 tag
HHHHHH

SEQ ID NO: 48 - DNA, 48 bp, Zea mays
aaacagatcaacaactggtttatcaatcaaaggaagcggcactggaaa

SEQ ID NO: 49 - protein, 16 aa, Zea mays
KQINNWFINQRKRHWK

SEQ ID NO: 50 - DNA, 63 bp, Saccharomyces pombe
gcgggctaccttctcggtaaaataaacctcaaagcatgcgctgcttgcgcgaaaaaaatactg

SEQ ID NO: 51 - protein, 21 aa, Saccharomyces pombe
AGYLLGKINLKACAACAKKIL

SEQ ID NO: 52 - DNA, 162 bp, Candida albicans
gaatgtgactcggaactggagattaaacggtataagcgggtcagagtcgcatccagaaagtgtcgggccaaatttaagcaacttttgcaacattatagggaggttgcagcagcaaaatcttcagaaaatgatcgcttgaggctcctcctcaagcagatgtgc

SEQ ID NO: 53 - protein, 54 aa, Candida albicans
ECDSELEIKRYKRVRVASRKCRAKFKQLLQHYREVAAAKSSENDRLRLLLKQMC

SEQ ID NO: 54 - DNA, 63 bp, Artificial Sequence
  PEP1 CPP
aaagagacatggtgggaaacatggtggaccgagtggagccagccaaagaaaaaaagaaaagtg

SEQ ID NO: 55 - protein, 21 aa, Artificial Sequence
  PEP1 CPP
KETWWETWWTEWSQPKKKRKV

SEQ ID NO: 56 - DNA, 33 bp, Human immunodeficiency virus type 1
tatgggaggaaaaaacgcaggcaaaggagacgc

SEQ ID NO: 57 - protein, 11 aa, Human immunodeficiency virus type 1
YGRKKRRQRRR

SEQ ID NO: 58 - DNA, 57 bp, Zea mays
gtgaggctccctcctcccgtgaggctccctccccctctcgtgagaccccctcccttg

SEQ ID NO: 59 - protein, 19 aa, Zea mays
VRLPPPVRLPPPLVRPPPL

SEQ ID NO: 60 - DNA, 2792 bp, Artificial Sequence
  pDAB135006
taaggtacccagctcttctggtttggtttggacctctggtcctgcaacttgaggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggcccatatatgcggaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtaatacgactcactatagggagagtatttttacaacaattaccaacaacaacaacaaacaacaacaacattacattttacattctacaactaccatgg

SEQ ID NO: 61 - DNA, 444 bp, Zea mays
atgacttgccttgtggccgtcaattctaattctgtaaatagtagtttcaacatcgagtgtggagatgctacagatgccaactttgagaaatacaatctcagtagaggctccgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaag

SEQ ID NO: 62 - DNA, 447 bp, Zea mays
atgaatgacggcgttgatgaacacatgatatggttggtagggttgaagaatatcttcgcccgacagcttcctaatatgcccaaagaatatattgtacgccttgtcatggatagaactcacaagtcaatgatggttatcaggaacaatattgtcgtggggggcattacttatcgcccttatgcaagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcagggtttcacaaaggagatcacattggacaaagaaagatggcaagggtacattaaagattatgacggaggaatattgatggagtgtaaaattgac

SEQ ID NO: 63 - DNA, 1155 bp, Zea mays
atggaggtgggcacgcgcgtgatgtgccggtggcgcgaccagaagctccacccggtcaaggtgatcgagcgccgcaagggctccgcgtgctcttcccccgccgactacgagtattacgtccactacaccgagttcaatagaagacttgacgagtgggttaagcttgatcagcttgatcttgacactgtcgagaccgttgtcgatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatatcgcgaagatcgaactggggagatatgagatagacacatggtatttctctccttttccaccagagtataatgactgcccgaagctgtttttctgtgaattttgcctcaacttcatgaagcgcaaagaacagcttcagaggcacatgaagaagtgtgatcttaagcaccccccaggtgatgaaatctatagaagtggaactctatcaatgttcgaggttgatgggaagaagaacaaggtttatggacagaacctttgttatctggctaagctatttcttgatcacaagacattgtactatgatgttgatttgttcttgttttatgtcctctgcgaatgtgatgatcggggatgtcatatggtgggatatttctctaaggaaaaacactccgaagaatcttataatttggcttgcattctcactctccccccataccaaagaaaaggatatgggaagttcctgattgctttctcatatgaactttccaagaaagaaggtaaagttgggacaccggagcgccctctctctgatcttggtctgctcagctatagaggttattggactagagtgcttctggaaattctaaagaaacataagggaaacatatctataaaggaactaagcgacatgacggcaataaaagcagatgacatattgagcacgctacagagcctggacctaatccagtaccgcaaagggcagcacgtcatctgcgctgacccgaaggtcctcgaccgccacctcaaggcggcggggcggggcggcctggacgtcgacgttagcaagctcatatggactccctacaag

SEQ ID NO: 64 - DNA, 1371 bp, Zea mays
atgatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttca

SEQ ID NO: 65 - DNA, 351 bp, Zea mays
tggctgtatgtcggaatgtgcttttcatcattctgctggcatgttgaagaccatcatttgtactcactgaactacatgcattggggtgctccaaagatgtggtatggagttccaggaaaggatgctgtaaatttggaggcagcaatgaggaaacacctacctgacttgtttgaggaacaacctgatttgcttcacaacctggttactcaattttcaacatcattgcttaaatctgaaggagtaccagtctaccgatgtgttcagcatgagggagagtttgtcctaacgttccctcgggcataccatgctggtttcaactgtggcttcaattgtgcagaagctgttaatgtg

SEQ ID NO: 66 - DNA, 177 bp, Zea mays
gtggcctttcaaatactaaatgaaaagacaactgtcttgtctcctgaagtgcttctttctgctggagttccttgctgcagattggttcaaaaccctggtgaatttgttatcacattccctggagcttatcattctggttttagccatggatttaattgtggagaagcaacaaacatt

SEQ ID NO: 67 - protein, 148 aa, Zea mays
MTCLVAVNSNSVNSSFNIECGDATDANFEKYNLSRGSVAGILTLDTVADYLPRRGPLKQRRTGIAYIANVAVRKEERRKGIAKMLVQEAEARARSWGCRSMALHCDVNNVAALRLYRNQGFKCIRVPEGAKWPEPKIAKGAEYNFMMK

SEQ ID NO: 68 - protein, 149 aa, Zea mays
MNDGVDEHMIWLVGLKNIFARQLPNMPKEYIVRLVMDRTHKSMMVIRNNIVVGGITYRPYASQRFGEIAFCAITADEQVKGYGTRLMNHLKQHARDADGLTHFLTYADNNAVGYFVKQGFTKEITLDKERWQGYIKDYDGGILMECKID

SEQ ID NO: 69 - protein, 385 aa, Zea mays
MEVGTRVMCRWRDQKLHPVKVIERRKGSACSSPADYEYYVHYTEFNRRLDEWVKLDQLDLDTVETVVDEKVEDKATSLKMTRHQKRKIDETHVEQGHEELDAASLREHEEFTKVKNIAKIELGRYEIDTWYFSPFPPEYNDCPKLFFCEFCLNFMKRKEQLQRHMKKCDLKHPPGDEIYRSGTLSMFEVDGKKNKVYGQNLCYLAKLFLDHKTLYYDVDLFLFYVLCECDDRGCHMVGYFSKEKHSEESYNLACILTLPPYQRKGYGKFLIAFSYELSKKEGKVGTPERPLSDLGLLSYRGYWTRVLLEILKKHKGNISIKELSDMTAIKADDILSTLQSLDLIQYRKGQHVICADPKVLDRHLKAAGRGGLDVDVSKLIWTPYK

SEQ ID NO: 70 - protein, 457 aa, Zea mays
MMALKQKDTDAAATATGTKKRRRVFFSDTDAGVEANECMKVFLVWNPGEVSSVDCTAIQPFDLNHFFGEDGKIYGYKNLKINVWISAKSFHGYADVSFDETSDGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMVPPADLMETVRQKLKINKKQFLRCWEILIFLSLDSQDHKSMDNFRACIYDRMKGEILGSASGTNRKRLLQMPTSFNKEASFAVYWTQEIEDEDEQTVEQQPEDLKTQEQQLNELVDIQIEEIAGVAKNVTS

SEQ ID NO: 71 - protein, 117 aa, Zea mays
WLYVGMCFSSFCWHVEDHHLYSLNYMHWGAPKMWYGVPGKDAVNLEAAMRKHLPDLFEEQPDLLHNLVTQFSTSLLKSEGVPVYRCVQHEGEFVLTFPRAYHAGFNCGFNCAEAVNV

SEQ ID NO: 72 - protein, 59 aa, Zea mays
VAFQILNEKTTVLSPEVLLSAGVPCCRLVQNPGEFVITFPGAYHSGFSHGFNCGEATNI

SEQ ID NO: 73 - DNA, 7262 bp, Artificial Sequence
  dCas9-GNAT1
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctacttgccttgtggccgtcaattctaattctgtaaatagtagtttcaacatcgagtgtggagatgctacagatgccaactttgagaaatacaatctcagtagaggctccgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaagtaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 74 - DNA, 7265 bp, Artificial Sequence
  dCas9-GNAT2
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctaatgacggcgttgatgaacacatgatatggttggtagggttgaagaatatcttcgcccgacagcttcctaatatgcccaaagaatatattgtacgccttgtcatggatagaactcacaagtcaatgatggttatcaggaacaatattgtcgtggggggcattacttatcgcccttatgcaagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcagggtttcacaaaggagatcacattggacaaagaaagatggcaagggtacattaaagattatgacggaggaatattgatggagtgtaaaattgactaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 75 - DNA, 7973 bp, Artificial Sequence
  dCas9-HAT1
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctgaggtgggcacgcgcgtgatgtgccggtggcgcgaccagaagctccacccggtcaaggtgatcgagcgccgcaagggctccgcgtgctcttcccccgccgactacgagtattacgtccactacaccgagttcaatagaagacttgacgagtgggttaagcttgatcagcttgatcttgacactgtcgagaccgttgtcgatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatatcgcgaagatcgaactggggagatatgagatagacacatggtatttctctccttttccaccagagtataatgactgcccgaagctgtttttctgtgaattttgcctcaacttcatgaagcgcaaagaacagcttcagaggcacatgaagaagtgtgatcttaagcaccccccaggtgatgaaatctatagaagtggaactctatcaatgttcgaggttgatgggaagaagaacaaggtttatggacagaacctttgttatctggctaagctatttcttgatcacaagacattgtactatgatgttgatttgttcttgttttatgtcctctgcgaatgtgatgatcggggatgtcatatggtgggatatttctctaaggaaaaacactccgaagaatcttataatttggcttgcattctcactctccccccataccaaagaaaaggatatgggaagttcctgattgctttctcatatgaactttccaagaaagaaggtaaagttgggacaccggagcgccctctctctgatcttggtctgctcagctatagaggttattggactagagtgcttctggaaattctaaagaaacataagggaaacatatctataaaggaactaagcgacatgacggcaataaaagcagatgacatattgagcacgctacagagcctggacctaatccagtaccgcaaagggcagcacgtcatctgcgctgacccgaaggtcctcgaccgccacctcaaggcggcggggcggggcggcctggacgtcgacgttagcaagctcatatggactccctacaagtaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 76 - DNA, 8186 bp, Artificial Sequence
  dCas9-HAT2
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctgcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcataggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 77 - DNA, 7388 bp, Artificial Sequence
  dCAS9-jmj
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatggcaccgaagaagaagcgcaaggtgcctgttttctatccatccgaagaggaattcaaggacaccttaaaatacattgagagtatacggtctacagcagaaccatatggaatttgtcgtattgtcccgggtggcggtggatcctggctgtatgtcggaatgtgcttttcatcattctgctggcatgttgaagaccatcatttgtactcactgaactacatgcattggggtgctccaaagatgtggtatggagttccaggaaaggatgctgtaaatttggaggcagcaatgaggaaacacctacctgacttgtttgaggaacaacctgatttgcttcacaacctggttactcaattttcaacatcattgcttaaatctgaaggagtaccagtctaccgatgtgttcagcatgagggagagtttgtcctaacgttccctcgggcataccatgctggtttcaactgtggcttcaattgtgcagaagctgttaatgtgggtggcggtggatccgacaagaagtacagcatcggcctcgccatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgacgccatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacggtggcggtggatccgtggcctttcaaatactaaatgaaaagacaactgtcttgtctcctgaagtgcttctttctgctggagttccttgctgcagattggttcaaaaccctggtgaatttgttatcacattccctggagcttatcattctggttttagccatggatttaattgtggagaagcaacaaacattaagagaccacgggaccgccacgatggcgagctgggaggccgcaagcgggcaaggtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 78 - protein, 1568 aa, Artificial Sequence
  dCas9-GNAT1
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPRDRHDGELGGRKRARGGSSSQQQQQQQQQQQQQQQQQQQQQQQQQQQQQQTCLVAVNSNSVNSSFNIECGDATDANFEKYNLSRGSVAGILTLDTVADYLPRRGPLKQRRTGIAYIANVAVRKEERRKGIAKMLVQEAEARARSWGCRSMALHCDVNNVAALRLYRNQGFKCIRVPEGAKWPEPKIAKGAEYNFMMK

SEQ ID NO: 79 - protein, 1569 aa, Artificial Sequence
  dCas9-GNAT2
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPRDRHDGELGGRKRARGGSSSQQQQQQQQQQQQQQQQQQQQQQQQQQQQQQNDGVDEHMIWLVGLKNIFARQLPNMPKEYIVRLVMDRTHKSMMVIRNNIVVGGITYRPYASQRFGEIAFCAITADEQVKGYGTRLMNHLKQHARDADGLTHFLTYADNNAVGYFVKQGFTKEITLDKERWQGYIKDYDGGILMECKID

SEQ ID NO: 80 - protein, 1805 aa, Artificial Sequence
  dCas9-HAT1
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPRDRHDGELGGRKRARGGSSSQQQQQQQQQQQQQQQQQQQQQQQQQQQQQQEVGTRVMCRWRDQKLHPVKVIERRKGSACSSPADYEYYVHYTEFNRRLDEWVKLDQLDLDTVETVVDEKVEDKATSLKMTRHQKRKIDETHVEQGHEELDAASLREHEEFTKVKNIAKIELGRYEIDTWYFSPFPPEYNDCPKLFFCEFCLNFMKRKEQLQRHMKKCDLKHPPGDEIYRSGTLSMFEVDGKKNKVYGQNLCYLAKLFLDHKTLYYDVDLFLFYVLCECDDRGCHMVGYFSKEKHSEESYNLACILTLPPYQRKGYGKFLIAFSYELSKKEGKVGTPERPLSDLGLLSYRGYWTRVLLEILKKHKGNISIKELSDMTAIKADDILSTLQSLDLIQYRKGQHVICADPKVLDRHLKAAGRGGLDVDVSKLIWTPYK

SEQ ID NO: 81 - protein, 3609 aa, Artificial Sequence
  dCas9-HAT2
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSSSQQQQQQQQQQQQQQQQQQQQQQQQQQQQQQALKQKDTDAAATATGTKKRRRVFFSDTDAGVEANECMKVFLVWNPGEVSSVDCTAIQPFDLNHFFGEDGKIYGYKNLKINVWISAKSFHGYADVSFDETSDGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMVPPADLMETVRQKLKINKKQFLRCWEILIFLSLDSQDHKSMDNFRACIYDRMKGEILGSASGTNRKRLLQMPTSFNKEASFAVYWTQEIEDEDEQTVEQQPEDLKTQEQQLNELVDIQIEEIAGVAKNVTSVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPRDRHDGELGGRKRARGGSSSQQQQQQQQQQQQQQQQQQQQQQQQQQQQQQALKQKDTDAAATATGTKKRRRVFFSDTDAGVEANECMKVFLVWNPGEVSSVDCTAIQPFDLNHFFGEDGKIYGYKNLKINVWISAKSFHGYADVSFDETSDGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMVPPADLMETVRQKLKINKKQFLRCWEILIFLSLDSQDHKSMDNFRACIYDRMKGEILGSASGTNRKRLLQMPTSFNKEASFAVYWTQEIEDEDEQTVEQQPEDLKTQEQQLNELVDIQIEEIAGVAKNVTS

SEQ ID NO: 82 - protein, 1619 aa, Artificial Sequence
  dCAS9-jmj
MAPKKKRKVPVFYPSEEEFKDTLKYIESIRSTAEPYGICRIVPGGGGSWLYVGMCFSSFCWHVEDHHLYSLNYMHWGAPKMWYGVPGKDAVNLEAAMRKHLPDLFEEQPDLLHNLVTQFSTSLLKSEGVPVYRCVQHEGEFVLTFPRAYHAGFNCGFNCAEAVNVGGGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGGSVAFQILNEKTTVLSPEVLLSAGVPCCRLVQNPGEFVITFPGAYHSGFSHGFNCGEATNIKRPRDRHDGELGGRKRAR

SEQ ID NO: 83 - DNA, 4104 bp, Artificial Sequence
  deactivated Spy Cas9
atggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagac

SEQ ID NO: 84 - protein, 1368 aa, Artificial Sequence [sequence omitted]

SEQ ID NO: 85 - DNA, 7115 bp, Artificial Sequence
  dCas9-CBF1A
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctacctgcgccaaggacatccagaaagcagccgccgaagcggccctcgccttccaagacgagacgtgcgatacaaccaccacgaatcatggcctcgatatggaggaaacgatggtcgaagccatctacaccccagagcagtcagaaggcgccttctacatggacgaggaaaccatgttcggcatgccgaccctcctcgacaacatggccgaaggaatgctcctcccacctccctcagttcagtggaaccacaactacgacggcgaaggcgacggagacgtttccctgtggagctactaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 86 - protein, 1519 aa, Artificial Sequence
  dCas9-CBF1A
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDKRPRDRHDGELGGRKRARGGSSSQQQQQQQQQQQQQQQQQQQQQQQQQQQQQQTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 87 - DNA, 20 bp, Artificial Sequence
  gRNA C5
gtcgtatcacccatgggcaa

SEQ ID NO: 88 - DNA, 20 bp, Artificial Sequence
  gRNA C4
gactcttccaaatttcgaag

SEQ ID NO: 89 - DNA, 20 bp, Artificial Sequence
  gRNA C3
gcaaatgacttctgtctcta

SEQ ID NO: 90 - DNA, 18 bp, Artificial Sequence
  gRNA C2
gttgccacaaggggagcc

SEQ ID NO: 91 - DNA, 18 bp, Artificial Sequence
  gRNA C1
gcctttgcagtttgcacc

SEQ ID NO: 92 - DNA, 1000 bp, Zea mays
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaatt

SEQ ID NO: 93 - DNA, 1699 bp, Artificial Sequence
  WUSCHEL EXPRESSION CASSETTE
acactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattactctatcagtgatagagtgggggatctcgactctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattcacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 94 - DNA, 4623 bp, Artificial Sequence
  ODP2 EXPRESSION CASSETTE
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccactctatcagtgatagagtgtaataaatagactctatcagtgatagagtgaactctatcagtgatagagtacaccccctccacaccctctttccccaacctcgtgttgttcggagcgcacacacacacaaccagatctcccccaaatccacccgtcggcacctccgcttcaagaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcagatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaagcgtacgtgccggcctggctctccgaaagggcgaattccagcacactggcggccgttactagacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 95 - DNA, 2974 bp, Artificial Sequence
  SULFONYLUREA-RESPONSIVE REPRESSOR EXPRESSION CASSETTE
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccatagagatgctcgatccgcacaagattcactacttacccttggaaggggaaagctggcaagatttcttgaggaacagggctaagtccatgagaaatgctttgctcagtcaccgtgatggagccaaggtctgtctaggtacgggcttcacggagcgacaatatgaaactgctgagaacacgcttgccttcctgacacaacaaggtttctcccttgagaacgccctctacgcattccaagcagtggggatctacactctgggttgtgtcttgctggatcaagagctgcaagtcgctaaggaggagagggaaacacctactactgatagtatgccgccactggttcgacaagcttacgaactcgcggatcaccaaggtgcagagccagccttcctgttcggccttgaactgatcatatcaggattggagaagcagctgaaggccgaaagtgggtcttaatgatagctgcagaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 96 - DNA, 3115 bp, Artificial Sequence
  ALS MARKER EXPRESSION CASSETTE
gcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 97 - DNA, 19809 bp, Artificial Sequence
  CRE/LOX RECOMBINATION SYSTEM
caactttattatacaaagttgatagatcctcatgtcttcatcgtaagcttgatatcgaacgttgctagttcattttatttggtatgtttctaatgctctcaatgttgtggcgatgggataactactgattcaaggcctatttacaaaaataagggctcatgtatatctatttagatattgacatttgtcaaacaacagataagctatatatgatatggcacttagtcaattttgacatttagttatcaattaggctggttagcttaatcattcggactaggcaaaaattttgggctaaggatattcaatatggctaaaatatttaaaaagaacaacttcaattcactcctaatccaaacgagggaaaaaccttttcatggactttgttactattccttttttatttatgaagaaattaattgtatgactgtgaaataatgactgcagttgttgtgctcactgaaagagcaaggagcgcaaggagggcaaatatcatgggctccaaatatttccttacatgttgtattatagggtcatgcacaatttgggttctagcaaaaaacatatgcaccaaatttttactaaaaacaataactaagaggtaagacttcgcgcgaacaactttgcacacacatataggtttactcatgaacttatattatgttttgcttggtatatgtgcacctgatttgagtgttcacggtcaaagcatatgtgccaatcactttctcaaaagaacatatcacagatttaagtactcaactacaagcacgtacagtcacatctatcttataaacacacaagcacacatccaaacaagaacattcaagcggttcgagctggcacatctttggcttggtgaagtatgcggtattgtctacatattaaccaagcatgtatctttaattttgatttgatgttttcaaatgaatatacaaagaacactcttaagaaattgactcaaattaattctcaaacaatatattgattatttattggaagttgcacacgccgatatatatgagacctttgttatgaagtacaactcatatgtattctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctccttttttttacaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagataacttcgtatagcatacattatacgaagttattgatcagaagaaactatgtgctgtagtatagccgctgcccgctggctagctagctagttgagtcatttagcggcgatgattgagtaataatgtgtcacgcatcaccatgcatgggtggcagtctcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtcaacggaagcgagtcgacctcgagggggggccccggccgaagcttcggccggggcccatcgataacgagtatcggtccccattgacacatctactcctaacgctaacaacattcttcacttctagtgtatggcatcgacaattggtactttaatcttgggtcttcacttttacaactaaacaacccaaatataaatattatttgagtgggtttggtgttcatcagaacattcccatctttggtaatgctacctagcataaaagtgagctatcacgttgggcagcccattccatgcaatttttaccttcctcaaaaaaaatctttgatatatttatggtataataatttaaacttcacattgatcataattttttcagcaaataagttccataatttggtgtttgcaatatcgaaattgttactcatagggtccagttgatttaatgacattagtgttgttaagttcacatgcttcaaagaattctacatgtctacaatgctgcatttgtctgtaaaatttgggttcttgtaaaaaatacatgtgttgaatatttaccaaaaaaatataatgcgatatgactttgtgtgagcatgtttggacacagttacaagtttacttctaaacttatattatgttttgcttcgtgcaagtacaagtgatttgaatatccaaggccaaagcatgtgtccatcactatatcaaatcaacataccatatatgtatatactcaacaaaaagcacaaataatcacatctatgttataaacacacccccacacaaccaaacattaacattcaataggttgtgctaggacatcattgggatgatgaagtaatattgtattatctatgtattgaccaagcatgagtttaaaattacgatttgatgttttcagttatttatatgatgaacatagttcagaaatatatcgagataaatctcaatcaatatattgattatttctaggaaacacatgccggtatgagggcaccattgtcgagtacatcttaagtgagaccgggttaccgcggccgcgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcgctccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtggatccgccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgataggtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggagagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatcccgcgccacctccgctttagttctgcatacagccaacccaaggatccaacacacacccgaggatatcacagtcgaccgccggggatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacccctcgctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaagaattcataacttcgtatagcatacattatacgaagttataccatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagatccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttc

SEQ ID NO: 98 - DNA, 2488 bp, Artificial Sequence
  RV028330
gaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtacttatttttacaacaattaccaacaacaacaaacaacaaacaacattacaattactatttacaattacagtcgacggatcaagtgcaaaggtccgccttgtttctcctctgtctcttgatctgactaatcttggtttatgattcgttgagtaattttggggaaagcttcgtccacagtttttttttcgatgaacagtgccgcagtggcgctgatcttgtatgctatcctgcaatcgtggtgaacttatttcttttatatccttcactcccatgaaaaggctagtaatctttctcgatgtaacatcgtccagcactgctattaccgtgtggtccatccgacagtctggctgaacacatcatacgatattgagcaaagatcgatctatcttccctgttctttaatgaaagacgtcattttcatcagtatgatctaagaatgttgcaacttgcaaggaggcgtttctttctttgaatttaactaactcgttgagtggccctgtttctcggacgtaaggcctttgctgctccacacatgtccattcgaattttaccgtgtttagcaagggcgaaaagtttgcatcttgatgatttagcttgactatgcgattgctttcctggacccgtgcagctgcggacggatccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 99 - DNA, 3022 bp, Artificial Sequence; identical to SEQ ID NO: 36
  DS-RED2 Cassette

SEQ ID NO: 100 - DNA, 3132 bp, Artificial Sequence
  (RV027603)
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcaacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 101 - DNA, 63 bp, Artificial Sequence
  T2A polycistronic linker
ggctccggcgagggtcgcggttccctcctgacctgcggcgacgtggaggaaaaccccggtccc

SEQ ID NO: 102 - protein, 21 aa, Artificial Sequence
  T2A polycistronic linker
GSGEGRGSLLTCGDVEENPGP

SEQ ID NO: 103 - DNA, 2573 bp, Artificial Sequence
  WUS alone PV-EGG CELL PRO
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgactagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 104 - DNA, 3701 bp, Artificial Sequence
  WUS + DZ470 PV-EGG CELL PRO
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgggctccggcgagggtcgcggttccctcctgacctgcggcgacgtggaggaaaaccccggtcccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgactagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 105 - DNA, 4646 bp, Artificial Sequence
  WUS + DZ470 + CDKA1 PV-EGG CELL PRO
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgggctccggcgagggtcgcggttccctcctgacctgcggcgacgtggaggaaaaccccggtcccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagaggctccggcgagggtcgcggttccctcctgacctgcggcgacgtggaggaaaaccccggtcccatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgactagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 106 - DNA, 4640 bp, Artificial Sequence
  WUS + DZ470 + CDKA3 PV-EGG CELL PRO
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgggctccggcgagggtcgcggttccctcctgacctgcggcgacgtggaggaaaaccccggtcccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagaggctccggcgagggtcgcggttccctcctgacctgcggcgacgtggaggaaaaccccggtcccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 107 - DNA, 3797 bp, Artificial Sequence
  BBM alone PV-EGG CELL PRO
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaactagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 108 - DNA, 4925 bp, Artificial Sequence
  BBM + DZ470 PV-EGG CELL PRO
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacactggctccggcgagggtcgcggttccctcctgacctgcggcgacgtggaggaaaaccccggtcccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgactagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 109 - DNA, 5870 bp, Artificial Sequence
  BBM + DZ470 + CDKA1 PV-EGG CELL PRO
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacactggctccggcgagggtcgcggttccctcctgacctgcggcgacgtggaggaaaaccccggtcccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagaggctccggcgagggtcgcggttccctcctgacctgcggcgacgtggaggaaaaccccggtcccatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgactagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 110 - DNA, 5864 bp, Artificial Sequence
  BBM + DZ470 + CDKA3 PV-EGG CELL PRO
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacactggctccggcgagggtcgcggttccctcctgacctgcggcgacgtggaggaaaaccccggtcccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagaggctccggcgagggtcgcggttccctcctgacctgcggcgacgtggaggaaaaccccggtcccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 111 - protein, 302 aa, Artificial Sequence
  WUS alone PV-EGG CELL PRO
MAANAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPPSGAAPPSPTLGFYAAGNGGGSAVLLDTSSDWGSSGAAMATETCFLQDYMGVTDTGSSSQWPRFSSSDTIMAAAAARAATTRAPETLPLFPTCGDDGGSGSSSYLPFWGAASTTAGATSSVAIQQQHQLQEQYSFYSNSNSTQLAGTGNQDVSATAAAAAALELSLSSWCSPYPAAGSM

SEQ ID NO: 112 - protein, 302 aa, Artificial Sequence; identical to SEQ ID NO: 111
  PV-EGG CELL PRO WUS +

SEQ ID NO: 113 - protein, 355 aa, Artificial Sequence; identical to SEQ ID NO: 21
  PV-EGG CELL PRO WUS +

SEQ ID NO: 114 - protein, 294 aa, Artificial Sequence
  PV-EGG CELL PRO WUS +
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILHGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRILGTPNEQSWPGVSCLPDFKTAFPRWQAQDLATVVPNLDPAGLDLLSKMLRYEPSKRITARQALEHEYFKDLEVVQ

SEQ ID NO: 115 - protein, 292 aa, Artificial Sequence
  PV-EGG CELL PRO WUS +
MDQYEKVEKIGEGTYGVVYKGKDRHTNETIALKKIRLEQEDEGVPSTAIREISLLKEMQHRNIVRLQDVVHNDKCIYLVFEYLDLDLKKHMDSSTDFKNHRIVKSFLYQILRGIAYCHSHRVLHRDLKPQNLLIDRRNNLLKLADFGLARAFGIPVRTFTHEVVTLWYRAPEILLGARHYSTPVDVWSVGCIFAEMVNQKALFPGDSEIDELFKIFRILGTPTKETWPGVASLPDYKSTFPKWPPVDLATVVPTLEPSGIDLLSKMLRLDPSKRITARAALEHDYFRDLEHA

SEQ ID NO: 116 - protein, 710 aa, Artificial Sequence
  BBM alone PV-EGG CELL PRO
MATVNNWLAFSLSPQELPPSQTTDSTLISAATADHVSGDVCFNIPQDWSMRGSELSALVAEPKLEDFLGGISFSEQHHKANCNMIPSTSSTVCYASSGASTGYHHQLYHQPTSSALHFADSVMVASSAGVHDGGAMLSAAAANGVAGAASANGGGIGLSMIKNWLRSQPAPMQPRVAAAEGAQGLSLSMNMAGTTQGAAGMPLLAGERARAPESVSTSAQGGAVVVTAPKEDSGGSGVAGALVAVSTDTGGSGGASADNTARKTVDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGGRMSAWGTVVSAAAAAAASSNDNMAADVGHGGAQLFSVWNDT

SEQ ID NO: 117 - protein, 710 aa, Artificial Sequence; identical to SEQ ID NO: 116
  PV-EGG CELL PRO BBM +

SEQ ID NO: 118 - DNA, 2771 bp, Zea mays
agcttgcatgcctgcaggtcgactctagaggatctgcaccggacactgtctggtggcataccagacagtccggtgtgccagatcagggcacccttcggttcctttgctcctttgcttttgaaccctaactttgatcgtttattggtttgtgttgaacctttatgcacctgtggaatatataatctagaacaaactagttagtccaatcatttgtgttgggcattcaaccaccaaaattatttataggaaaaggttaaaccttatttccctttcaatctccccctttttggtgattgatgccaacacaaaccaaagaaaatatataagtgcagaattgaactagtttgcataaggtaagtgcataggttacttagaattaaatcaatttatacttttacttgatatgcatggttgctttcttttattttaacattttggaccacatttgcaccacttgttttgttttttgcaaatctttttggaaattctttttcaaagtcttttgcaaatagtcaaaggtatatgaataagattgtaagaagcattttcaagatttgaaatttctccccctgtttcaaatgcttttcctttgactaaacaaaactccccctgaataaaattctcctcttagctttcaagagggttttaaatagatatcaattggaaatatatttagatgctaattttgaaaatataccaattgaaaatcaacataccaatttgaaattaaacataccaatttaaaaaatttcaaaaagtggtggtgcggtccttttgctttgggcttaatatttctccccctttggcattaatcgccaaaaacggagactttgtgagccatttatactttctccccattggtaaatgaaatatgagtgaaagattataccaaatttggacagtgatgcggagtgacggcgaaggataaacgataccgttagagtggagtggaagccttgtcttcgccgaagactccatttccctttcaatctacgacttagcatagaaatacacttgaaaacacattagtcgtagccacgaaagagatatgatcaaaggtatacaaatgagctatgtgtgtaatgtttcaatcaaagtttcgagaatcaagaatatttagctcattcctaagtttgctaaaggttttatcatctaatggtttggtaaagatatcgactaattgttctttggtgctaacataagcaatctcgatatcacccctttgttggtgatccctcaaaaagtgataccgaatgtctatgtgcttagtgcggctgtgttcaacgggattatccgccatgcagatagcactctcattgtcacataggagagggactttgctcaatttgtagccatagtccctaaggttttgcctcatccaaagtaattgcacacaacaatgtcctgcggcaatatacttggcttcggcggtagaaagagctattgagttttgtttctttgaagtccaagacaccagggatctccctagaaactgacaagtccctgatgtgctcttcctatcaattttacaccctgcccaatcggcatctgaatatcctattaaatcaaaggtggatcccttggggtaccaaagaccaaatttaggagtgtaaactaaatatctcatgattcttttcacggccctaaggtgaacttccttaggatcggcttggaatcttgcacacatgcatatagaaagcatactatctggtcgagatgcacataaatagagtaaagatcctatcatcgaccggtataccttttggtctacggatttacctcccgtgtcgaggtcgagatgcccattagttcccatgggtgtcctgatgggcttggcatccttcattccaaacttgttgagtatgtcttgaatgtactttgtttggctgatgaaggtgccatcttggagttgcttgacttgaaatcctagaaaatatttcaacttccccatcatagacatctcgaatttcggaatcatgatcctactaaactcttcacaagtagatttgttagtagacccaaatataatatcatcaacataaatttggcatacaaacaaaacttttgaaatggttttagtaaagagagtaggatcggctttactgactctgaagccattagtgataagaaaatctcttaggcattcataccatgctgttggggcttgcttgagcccataaagcgcctttgagagtttataaacatggttagggtactcactatcttcaaagccgagaggttgctcaacatagacctattcaccccatttgatcacttttttggtccttcaggatctaatagttatgtataatttagagtctcttgtttaatggccagatatttctaattaatctaagaatttatgatattttttaattttttatcatgtctgatgagaattaacataaaggctcaattgggtcctgaattaataatagagtgaaaattaatccagaggctctattagaaccttcaattagtaataccaagatatatataagatagtagagtatagtttaaatgttggcattgttcattctttcttttgttatttaatttatgctttccacggtggttagtggttacttctgaagggtccaaataatgcatgaagagtttgaggacaagaagtctgccctaaaaatagcgatgcaaaggcatggtgtccaagccatacatatagcgcactaattttatcagcagaacaatggtatttataggtcctagtgcccaggcaacaagagacacgaataaagcatcgatcacgacac

SEQ ID NO: 119 - DNA, 2349 bp, Artificial Sequence
  ZmRKD2pro::BBM404
tatgcctttctgtgtgtgttgacaagcaaaagtagggggaaaaataaaaacaatatatttttagggaagaaaaaatatggaacctttccacagaaagtagccgagatcatatcgcccatccagcccggcggcccgttaacaaacggaactgatgaacacgggccaagtagcggcacagaacatgagcaagagctcattattcatgcgtgtgatttaactacagttacccgtgctaataataatacaactaaatgcgcgtgagcacgaactcgggaagcaatgaatgagatggaacggatcgagggcgtttccccgtcccgccgccgtgagaaatgaatgggcgagccctggagctgctcctgctcatcatggcatgggtagattattgatgcatatgggctcgggaagctagctagccgcgcccgcgcgtacgtgctccactaccgctacggctgcatgcaatccaatgcaacgaacaggctcgatcggttttgcagccaaaatccactcaagatcaccgcgcaattaattactgcgcgcgcgccacacatctcgactcgctcatgcatgcacgcacgctgattgcacacgttcacatccatcgtcacttcactgcatccagtccacacccatgcatctctctcatcccagagtacatatatgacaagtgttctgctcttcgttcgttgctgcttgtgttgtgatatggtatacgcggtaaaacagtagcttggatacgtacctagctagctcttcgttcgttgctgcttgtgttgtgacagacaggatcccaacctaggatccatggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 120 - DNA, 3118 bp, Artificial Sequence
  PvEC1pro::BBM404
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 121 - protein, 405 aa, Zea mays
MDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGG

SEQ ID NO: 122 - DNA, 1658 bp, Artificial Sequence
  BBM404-FLAG-KNOTTED-1 CPP
caccatcaccatcaccatctggttccgcgatccatggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggagactacaaagacgacgacgacaaatccggtggaggcggcagcggtggcggaggctccggaggcggtggctccaagcagatcaacaactggttcatcaaccagcggaagcggcactggaagtaataacctaggtgtacaagcttgtcgacactagtctagaggtacccagctcttctggtttggtttggacctctggtcctgcaacttgaggtagtcaagatgcataataaataacggattgtgtccgtaatcacacgtggtgcgtacgataacgcatagtgtttttccctccacttaaatcgaagggttgtgtcttggatcgcgcgggtcaaatgtatatggttcatatacatccgcaggcacgtaataaagcgaggggttcgaatccccccgttacccccggtaggggc

SEQ ID NO: 123 - protein, 456 aa, Artificial Sequence
  BBM404-FLAG-KNOTTED-1 CPP
HHHHHHLVPRSMDTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGGDYKDDDDKSGGGGSGGGGSGGGGSKQINNWFINQRKRHWK

SEQ ID NO: 124 - DNA, 837 bp, Zea mays
atggactccagcagcttcctccctgccgccggcgcggagaatggctcggcggcgggcggcgccaacaatggcggcgctgctcagcagcatgcggcgccggcgatccgcgagcaggaccggctgatgccgatcgcgaacgtgatccgcatcatgcggcgcgtgctgccggcgcacgccaagattagcgacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtccctggggccgccccatcgcgcggcggcgaccaccacccgcactccatgtcgccagcggcgatgctcaagtcccgcgggccagtctccggagccgccatgctaccgcaccaccaccaccaccacgacatgcagatgcacgccgccatgtacgggggaacggccgtgcccccgccggccgggcctcctcaccacggcgggttcctcatgccacacccacagggtagtagccactacctgccttacgcgtacgagcccacgtacggcggtgagcacgcgatggctgcatactatggaggcgccgcgtacgcgcccggcaacggcgggagcggcgacggcagtggcagtggcggcggtggcgggagcgcgtcgcacacaccgcagggcagcggcggcttggagcacccgcacccgttcgcgtacaagtag

SEQ ID NO: 125 - protein, 278 aa, Zea mays
MDSSSFLPAAGAENGSAAGGANNGGAAQQHAAPAIREQDRLMPIANVIRIMRRVLPAHAKISDDAKETIQECVSEYISFITGEANERCQREQRKTITAEDVLWAMSRLGFDDYVEPLGAYLHRYREFEGDARGVGLVPGAAPSRGGDHHPHSMSPAAMLKSRGPVSGAAMLPHHHHHHDMQMHAAMYGGTAVPPPAGPPHHGGFLMPHPQGSSHYLPYAYEPTYGGEHAMAAYYGGAAYAPGNGGSGDGSGSGGGGGSASHTPQGSGGLEHPHPFAYK

SEQ ID NO: 126 - DNA, 2899 bp, Artificial Sequence
  BBM404
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 127 - DNA, 4027 bp, Artificial Sequence
  BBM403 + Dz470
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaggctccggcgagggtcgcggttccctcctgacctgcggcgacgtggaggaaaaccccggtcccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 128 - DNA, 4972 bp, Artificial Sequence
  BBM403 + Dz470 + CDKA1
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaggctccggcgagggtcgcggttccctcctgacctgcggcgacgtggaggaaaaccccggtcccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagaggctccggcgagggtcgcggttccctcctgacctgcggcgacgtggaggaaaaccccggtcccatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 129 - DNA, 4966 bp, Artificial Sequence
  BBM403 + Dz470 + CDKA3
cctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagatcccggcggatctcgactctagaggatcgctcaggaaggccgctgagatagagccatggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaggctccggcgagggtcgcggttccctcctgacctgcggcgacgtggaggaaaaccccggtcccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagaggctccggcgagggtcgcggttccctcctgacctgcggcgacgtggaggaaaaccccggtcccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 130 - DNA, 8237 bp, Artificial Sequence
  NAC7 SDN (UBIZM::Cas9)
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccaccggtcgccaccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattcgtaatcatgtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgctgatccgatatcgatgggccctggccgaagcttggtcacccggtccgggcctagaaggccagcttcaagtttgtacaaaaaagcaggctccggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtgatgcatccggacggggttttagagctagaaatagcaagttaaaataaggctagtccgttatcaacttgaaaaagtggcaccgagtcggtgcttttttttt

SEQ ID NO: 131 - DNA, 17109 bp, Artificial Sequence
  E32/AAD1 Targeting (ZmEC1::ZFN) + B-Peru
agtcagcatcatcacaccaaaagttaggcccgaatagtttgaaattagaaagctcgcaattgaggtctacaggccaaattcgctcttagccgtacaatattactcaccagatcctaaccggtgtgatcatgggccgcgattaaaaatctcaattatatttggtctaatttagtttggtattgagtaaaacaaattcggcgccatgcccggccatgcccgggtagggataacagggtaatagatggttcctgtgtgaggcggccgcctcgaggctggctacccccaattccccgtatacttgttccataatcttcttttagcttattgatatgttaaaattttactaaaatttcaatacaactaattataaaatagctaactgaactctaaagtagaaatctattataattttaaatcttgtttttcaatttatattaatttaatataattaatttgtatttattgtatttgcagatttctcgcgggcataaatttatcggtgaagggataaaaagttctcctatgtgttcgcagggatggaggctagaaatttttcttccaccgggaaacaggaatggagctttccattgcttcggtgattatcctttttttcaagtataatcggatcttttttcagctgtattttcgatatgctctgcgctgtcggcctgtcaaacccgcacttccaccatgctacacttccagcttcaaggccaccaggcttattattccatgtcttattttaaacctctataaataataaaaaaaatattttgcatgatcatagtcgaggtagcaacatgcacttgttcaaaactacatgcccgtgctctatgccgcggcctgtgtcgcagacacgtcgtgtgaggaggtgactgatgtaggcgaagagtcgaagacgactagacgtcgagcccacacaggcacacagaaggtgagaagggcagacatgaatcgagagtttgaatgcaatttcagggagtaagcttggacgcggggcgcaactagtgttaaaaaaaaagttgtgtaaccgtgacacatttttttaaaaatgttatttttaaaatttaaatcgtgtcgcgaatctatggaagatgctcatagttgcttcaaggaaaacagtttgtagcaggagtaagaattatcactattatttatctcggcaaagccaaactttctcgagacaatttattcagcgagattggacgtggaaacgatcgaacgaacacatccacatcctgatccatagcgagctctaggtgattaagctaactacttagaagttgatctcgccgttattgaatttcctgcggacctcttccagcgtcagggtgccggccttgatcatctccccgccaatgagcagttcctcgacggagagcacagcgccattgcagttggtcttcctgttgaggcgcgtcagctgcgccttgtagttacccttgaaatgcccggagacaaacaggaatttgaactcggtcacggagcttggatacaccttccaccactcattcgggttaatgtgcttgttcctggtttggttttccttgacgtagcgctgcatctcatcggcctggccgattgggagattgtacccgccgctgtaagccttcgtgtcgacgatcacgccataatcgatcggggaacccacggtgtagatcgcgccgtctggcttcctgctaccccccaggtgtttgccgcgatagccgtacaccttcataaagaactccatgaccttcatttcgagaatcctgtcttgggtggagttgcgggcaatctcgatcagctcgatgtactcatgcgggacgtacttgagcttgtgcctgagttcgcttttcttctcttccagctccctggcagcggcctcgctcttgctcttgaccagctgggatccccgcagtccgcagcgttgggcatgctttgtgcggttggcgctctgcgcaaactttctcccacagatgtcgcaggcgaatggcttctcaccggtgtgcgtccggatgtgccggctcaggtcgtcactacgggagaagttcctcatgcagatccggcactgaaacggtttctgtgaacccgtatggatctttgtgtggcgggtcaggttgccggaggtggcgaacttgcggccgcaaatgtcgcacgcaaacggcttttcgccagtgtgggtgcggatatggcgggacaggtgggagcggtcgctgaagttgcgcatacagatgcggcattggaaaggcttttccccggtgtgtatcttggtgtgggtcttgcggtcggcggagcgggcaaactttctcatgcaaatcctacactggaatggcctctccgccatagcagcgggtaccccgtggatgcccaccttcctgtacctggacctcctggcggactccctgttggactccttcctcttcctcggggccatcctagggccgggattctcctccacgtcaccgcatgttagaagacttcctctgccctctccgccgccagatctgaagttgatctcgccgttattgaatttcctgcggacctcttccagcgtcagggtgccggccttgatcatctccccgccaatgagcagttcctcgacggagagcacagcgccattgcagttggtgatgtggttgaggcgcgtcagctgcgccttgtagttacccttgaaatgcccggagacaaacaggaatttgaactcggtcacggagcttggatacaccttccaccactcattcgggttcaggtgcttgtccctggtttggttttcctcgacgtagcgctccatctcatcggcctggccgattgggagattgtacccgccgctgtaagccttcgtgtcgacgatcacgccataatcgatcggggaacccacggtgtagatcgcgccgtctggcttcctgctaccccccaggtgtttgccgcgatagccgtacaccttcataaagaactccatgaccttcatttcgagaatcctgtcttgggtggagttgcgggcaatctcgatcagctcgatgtactcatgcgggacgtacttgagcttgtgcctgagttcgcttttcttctcttccagctccctggcagcggcctcgctcttgctcttgaccagctgggatccccgcagtccgcagcgttgggcatgcttcaggcgggcgccggtgtccgcaaactttctcccacagatgtcgcaggcgaatggcttctcaccggtgtgcgtccggatgtggcgggtcaggtcgccggactgggagaagttcctcatgcagatccggcactgaaacggtttgggaatcggtgcccttgggtgcgtatggatctttgtgtgctcgcgcaggttgtcggagcgggcgaacttgcggccgcaaatgtcgcacgcaaacggcttttcgccagtgtgggtgcggatatggcgggtcagggagccggactgtgagaagttgcgcatacagatgcggcattggaaaggcttttccccggtgtgtatcttggtgtgcttggacaggtcgtcggagcgggcaaactttctcatgcaaatcctacactggaatggcctctccgccatagcagcgggtaccccgtggatgcccaccttcctgtacctggacctcctggcggactccctgttggactccttcctcttcctcggggccatgtgatctaagaccagtgaagacttgggatgatgaatggagctcaggagatactatgcgctagttggtttgtatagctgaggctcgcgactgtacttatagaaggtgcaggcggacactgcaggcaagccaagagtcacaaactcacaattagtttcagaatgtgtaaagccacgtttttaatctccctctctctaatggaaaataagtgggctttactgccacagtgacactaccgcactaatgtaaagttccaccgtgccatggagccacggcacttcaacggacacaacataagtcatgcctgctcattttccaaatttgtgtgttttgattttaacccccagggtgttttgcacgtcagttcgatttttaaccttgaactttaaaactgaataccgaacgagtcctccttactggttttcaaaggtcgttttttttaaaaaaaaacttgatagctaatttacaaggcatgcaaaaacaaatagttttcctttgtgcgaggaagtttaaatactactgtataatttacgggaccgagggactacaaggcatctcagcaagtcagagtcatttcctggtatatgtaccaagttcttctacatcaagtcagtgctcattgactaattatgtgtttggtttgagatcaaaataggatgagacggggataacaccgttctctcgatttttttggatcatgctgtcataaaaaattacttcggtgttcatctcgttctcgtgtgactctcatccaaatgttatagaaaatgtggccgccctctttgatcccttcttatacgtacaaccaaacacacgttaaaagatggattgaataattgaccgtgtataactgttataacacatgttctttaggcactgataattgcacaaacagaaaagacacgatcccctccgaggcaggcccaacccccagctcacagggtcacagctgtggattagactttgtacactgctgcccatgtctccagctaaactgaaaggttcacctgtacttgagtacttctgttggctggactttctaagatatagtgaaaccaagaatgtatctatgatctatcatgaaatgacaacattaccaggttcaaaattttgaacaagagaagaagctgctgtttgactcagcccgactactttagaacacatcattacatttggactaaacctaccagttctgatagccagattgtgccattctaggaatacgtctgatggtgcaccgagactttggagtacattcaacaagaggcccaacgaaacacttttgaaggctcaatctatagcctcatcagactatatacagacaatgcaaaaccacaaaactaataacagcgacacgggcaatgttaggtgcaaagaagtggcggcagaaacgtgaattgtgagaggaaacaaacaattgtcgacagatggatcgacagtagttatcaaacctaggccattgaagtagcaactatcctcactctgatcatgctgctggtagttcacctttgtcatgcggccgctccggataaattcatccgactcaggttattgtttggcggccgcaagctgtactgaagcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacaccacaggtacctcttcctggagcaccagtgtccatggacgagagagcgagcgcgatggggaggagggcgtgttgcgcgaaggaaggcgttaagagaggggcgtggacgagcaaggaggacgatgccttggccgcctacgtcaaggcccatggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctcgagtccgacgaggactggctccgctgtcagacggccgggcagcttgcgtaataatgagtagttagcttaatcacctagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgtagttccctcattcactagctgcggccgctgcgaagtagtcaagggtcgcggccgcgtgaagtcgattccttctgaagcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacaccacaggtacctcttcctggagcaccagtgtccatgcgatgcccgatgcgatcaacggaagcggatggcccgtaaggatagcctgatttactctctattcagtccgtaggtttaatgagtctgttggattagcctacactttttctgtaaaatctattttagatagtagctaaatcagtaaatttggctagtatttttagctattctcttggagtttgctataagaccagaacatgtaaattggaagtttgtggacccggacgagaatgcatgacaaatccagagtattgatgatggaattcacctattttacccgactcttccattgtgtccatttctcatcatccccgggcgctttctgcatccggtacagctgacatgacacgttcacgcgttacatggctgatggctcacaagtcacccccacatgtctagtgttcgcccaggcagatcgtcctcggcctgcgctgccgtgctcttgccgccgcttgcttgggccctgctggcgcccgctgccgatcacacggcctacgcggtgcaggcagcgccaccgaacccgcagtcttgttgtgccgataggtggcagtggcagtggcactggcacggcacgcgatcgatcgctccgctcatctgctgacagtggatagagcagcgttggccgttggggccggatctccgtgaagcggtcgtccctgctgtactgtgccgctatggcgtgtcgctttcgccatgttttcttttcttttttttttctttttctttttgctagggcggtttctcgttcgctggtaacagggaccacttcggttgatccgttgaatttactgaaagagatgggaatggtcgctgtgcccgggacattgaatgagatgttgtgtaagtgaatatggctttagccttttgcgagtggggcggcaatgcacggcatgaactataatttccggtcaaacttttgtgtggaaatggatgctaaacgaacacaaaccgggtttaaaccagaggccgacacggcacacacggcgacattcaccgccggcttcctccgtcgccactcggcacaaggctcatcagtcgctagtctatattgagcggccgctatatgaatgcaatcgaacaatggttaaagcggccgcaaacaaaggcttacttgagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcaggtacacgacaccatggctcatgctgccctcagccctctctcccaacgctttgagagaatagctgtccagccactcactggtgtccttggtgctgagatcactggagtggacttgagggaaccacttgatgacagcacctggaatgagatattggatgccttccacacttaccaagtcatctactttcctggccaagcaatcaccaatgagcagcacattgcattctcaagaaggtttggaccagttgatccagtgcctcttctcaagagcattgaaggctatccagaggttcagatgatccgcagagaagccaatgagtctggaagggtgattggtgatgactggcacacagactccactttccttgatgcacctccagctgctgttgtgatgagggccatagatgttcctgagcatggcggagacactgggttcctttcaatgtacacagcttgggagacgttgtctccaaccatgcaagccaccatcgaagggctcaacgttgtgcactctgccacacgtgtgttcggttccctctaccaagcacagaaccgtcgcttcagcaacacctcagtcaaggtgatggatgttgatgctggtgacagagagacagtccatcccttggttgtgactcatcctggctctggaaggaaaggcctttatgtgaatcaagtctactgtcagagaattgagggcatgacagatgcagaatcaaagccattgcttcagttcctctatgagcatgccaccagatttgacttcacttgccgtgtgaggtggaagaaagaccaagtccttgtctgggacaacttgtgcaccatgcaccgtgctgttcctgactatgctggcaagttcagatacttgactcgcaccacagttggtggagttaggcctgcccgctaataagtagttagcttaatcacctagggtcgcagcgtgtgcgtgtccgtcgtacgttctggccggccgggccttgggcgcgcgatcagaagcgttgcgttggcgtgtgtgtgcttctggtttgctttaattttaccaagtttgtttcaaggtggatcgcgtggtcaaggcccgtgtgctttaaagacccaccggcactggcagtgagtgttgctgcttgtgtaggctttggtacgtatgggctttatttgcttctggatgttgtgtactacttgggtttgttgaattattatgagcagttgcgtattgtaattcagctgggctacctggacattgttatgtattaataaatgctttgctttcttctaaagatctttaagtgcttagtagaagagggcacttaagcggccgcaattaggagcgtgtgcagactggaacgcccatgcggccgcctaactgacttctttagaattggcacaggaacactggccactgcccttgatgtgcaattatgcctgcgaaagcctaggcaacacacgcgaataaacgagcgaatgacacggaaagctgatgtggtatgaattatacaacattatgggccaaaatattattctatccaccattgtgtagccacagcatcggtatttgagttgtgcgaggacaaatccctcgtgaggtcaaaaacagcaaataataaacccatctcctgaagacaccaaaaaaaaggagcagctcctcgtgtcaatgaacaagcgtcacaagaaaagggagcacgtaaataacctcttcaattgcttcagcatgaaaagaacgggaagaaatgcaagtctacagaggaaagtgcagctgtttcggctgccatggcaagttcctacatgggcgaggaaaagctgaactggattccagtcttcgcgctgtcatgctcagcttgctttaggatgcggcaatagttcacctggatgaaaaagatacaagttagtcttgaagcagtcgagtggacatccaaagtatcaaaatcgaaagcttgtaaatggggaaggaaatatacctctacccggaaaagtttggtaggcaaaataatcccaacgccagcagagctccggaacgtttgccgaaattcagaagccgaaaagttcttgtactcaccctccgacagtttcgcaaggtttccagcagtaaggaatgcgtggccatggattccagcgtctctgaatatcttgaggggcagatcaaaagaaaggtcagcgaaggcagacacggccagatcacctcccaagtaatcccttccagggtcagccgagccactctccgagttattaaggacatgcctccgcgcctctgttgggccaactccccttaatctgaaacccagcagagatgacggtccgcccaagctgcacactggagaagaattacctccaagataaaacctctctggcactgatgaagtcgaattcatgcgatgcccgatgcgatcaacggaagcggatggcccgccgacgagacacctcaaggacccatttaaatcgttattagtaaggcgcgtgatggcgctctcagcttccccggctcaggaagaactgctgcagcctgctgggaggccgttgaggaagcagcttgctgcagccgcgaggagcatcaactggagctatgccctcttctggtccatttcaagcactcaacgacctcgggtgctgacgtggacggacgggttctacaatggcgaggtgaagacgcgtaagatctcccactccgtggagctgacagccgaccagctgctcatgcagaggagcgagcagctccgggagctctacgaggccctccggtccggcgagtgcgaccgccgcgcggcgcggccggtgggctcgctgtcgccggaggacctcggggacaccgagtggtactacgtgatctgcatgacctacgccttcctgccgggccaaggcttgcccggcaggagttccgcgagcaacgagcatgtctggctgtgcaacgcgcacctcgccggcagcaaggacttcccccgcgcgctcctggccaagagcgcgtccattcagacaatcgtctgcatcccgctcatgggtggcgtgcttgagcttggtactactgataaggtgccggaggacccggacttggtcagccgagcaaccgtagcattctgggagccgcaatgtccgacatactcgaaagagccgagctccaacccgtcagcatacgaaaccggggaagccgcatacatagtcgtgttggaggacctcgatcacaatgccatggacatggagacggtgactgccgccgccgggagacacggaaccggacaggagctaggagaagtcgagagcccgtcaaatgcaagcctggagcacatcaccaaggggatcgacgagttctacagcctctgcgaggaaatggacgtgcagccgctagaggatgcctggataatggacgggtctaatttcgaagtcccgtcgtcagcgctcccggtggatggctcaagcgcacccgctgatggttctcgcgcgacaagtttcgtggtttggacgaggtcatcgcactcctgctcgggtgaagcggcggcggtgccggtcatcgaggagccgcagaaattgctgaagaaagcgttggccggcggcggtgcttgggcgaacacgaactgcggtggcgggggcacgacggtaacagcccaggaaaacggcgccaagaaccacgtcatgtcagagcgaaagcgccgggagaagctcaacgagatgttcctcgttctcaagtcgttggttccctccattcacaaggtggacaaagcatccatcctcgccgaaacgatagcctatctaaaggagcttcaacgaagggtacaagaactggaatccaggaggcaaggtggcagtgggtgtgtcagcaagaaagtctgtgtgggctccaactccaagaggaagagtccagagttcgccggtggcgcgaaggagcacccctgggtcctccccatggacggcaccagcaacgtcaccgtcaccgtctcggacacgaacgtgctcctggaggtgcaatgccggtgggagaagctcctgatgacacgggtgttcgacgccatcaagagcctccatttggacgctctctcggttcaggcttcggcaccagatggcttcatgaggctcaagataggagctcagtttgcaggctccggcgccgtcgtgcccggaatgatcagccaatctcttcgtaaagctatagggaagcgataataatgagtagttagcttaatcacctagatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgtaggtagttaatattgcggccgcttatattccatttaatcattaccctgttatccctagcggccgcttaggccgcttacacatagacacacacatcatctcattgatgcttggtaataattgtcattagattgtttttatgcatagatgcactcgaaatcagccaattttagacaagtatcaaacggatgtgacttcagtacattaaaaacgtccgcaatgtgttattaagttgtctaagcgtcaatttgatttacaattgaatatatcctgccccagccagccaacagctcgatttacaattgaatatatcctgccggccggcccacgcgtgtcgaggaattctgatctggcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagcc

SEQ ID NO: 132 - DNA, 24515 bp, Artificial Sequence
  E32/AAD1 Targeting (ZmUBI::ZFN) + B-Peru
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcataatgaggatcgaggatggttttagagctagaaatagcaagttaaaataaggctagtccgttatcaacttgaaaaagtggcaccgagtcggtgctttttttttgcggccgcgaattccaccggtgttaacggcaaacgctaattagtcactaggcccaggaaacactaactaagccctagcttatcctagcgcaacctagttaggtcttggttaccggcctagaaggccgatctcccgggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcacccagctttcttgtacaaagtggccgttaacggatcggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcgggcataatgaggatcgaggatgaggggccgccggatagatggcgtctagcatatcgataggacatgacaagtggtacgatccccgtcacatgtccatggaggcatctgatatggacacggcgtgtatctatcgcggctggaacagaaccagcgctcgcgcggcggtcggcgggagggacagaccttggctccgtgcgttcaggttgtgcttgtgccgcgcgccacgcacggtctccgccgcctgcagctgaaattttagatttacatcctatccctttattttttttatttgtcacaattcagttcaaaaatgaagaacggaggtagtgcatcctttgtgagactaatgaaaatcacatctggatcctgaaatcggcgtcgtaacctacaaggccacggactggattagatagtggtccatggtgcataatgaggatcgaggggtaccggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctagggaagttcctattccgaagttcctattctctagaaagtataggaacttcagatccaccgggatccaccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggatccaccatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaccggtgccatgaggagcaatcattgttcaagacatgatgcaaagctagaaaactttgattgtggccgtcctaattgtgaagtttaggccggggggaacttcatgaaccctatcgaagcttaattagttcttttttgttgttagccatgtttgtattgtagtttaggtgaacaacatgacgccgcacccgcgatctcagggctcgtccccacacaggagggcacgtcgtcgtcttcgccgccgagcatcagagattcagagcacgtacacgcacatctcaagcaaacggagtagtacgtcctactcctacgtacatacctagccgacgacctttatgtgcacaccaccactgctctgctgcccggcctctccgtcgtccgttcatcaccagctggtctggtccttcaatttccatgcgtcggtccgcccgcataatgaggatcgaggatgaggcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 133 - DNA, 8964 bp, Artificial Sequence
  PHP87078
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 134 - DNA, 8924 bp, Artificial Sequence
  RV020636 (3XENH-3XEME-WUS)
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaaacaacgtaagcgcttacgcaccgaacaacgtaagcgcttacgcaccgaacaacgtaagcgcttacgcacccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggggaggagggcgtgttgcgcgaaggaaggcgttaagagaggggcgtggacgagcaaggaggacgatgccttggccgcctacgtcaaggcccacggcgaaggcaaatggagggaagtgccccagaaagccggtttgcgtcggtgcggcaagagctgccggctgcggtggctgaactacctccggcccaacatcaggcgcggcaacatctcctacgacgaggaggatctcatcatccgcctccacaggctcctcggcaacaggtggtcgctgattgcaggcaggctgcctggccgaacagacaatgaaatcaagaactactggaacagcacgctgggccggagggcaggcgccggcgccggcgccggcggcagatccacgatggcgctttcagcttcccgagttcagcaggcggaagaactgctgcaacgacctgctgagaggcagctgatgaggagccagcttgctgcagccgccaggagcatcaactggagctacgccctcttctggtccatttcagacactcaaccaggggtgctgacgtggacggacgggttctacaacggcgaggtgaagacgcggaagatttccaactccgtggagctgacatccgaccagctcgtcatgcagaggagcgaccagctccgggagctctacgaggccctcctgtcgggcgagggcgaccgccgcgctgcgcctgcgcggccggccggctctctgtcgccggaggacctcggcgacaccgagtggtactacgtggtgtccatgacctacgccttccggccaggccaagggttgcccggcaggagtttcgcgagcgacgagcatgtctggctgtgcaacgcgcacctcgccggcagcaaagccttcccccgcgcgctcctcgccaagagcgcgtccattcagtcaatcctctgcatcccggttatgggcggcgtgcttgagcttggtacaactgacacggtgccggaggccccggacttggtcagccgagcaaccgcggctttctgggagccgcagtgcccgagctccagcccgtcaggacgagcaaacgagacgggcgaggccgcagcagacgacggcacgtttgcgttcgaggaactcgaccacaataatggcatggacgacatagaggcgatgaccgccgccgggggacacgggcaggaggaggagctaagactaagagaagccgaggccctgtcagacgacgcaagcctggagcacatcaccaaggagatcgaggagttctacagcctctgcgacgaaatggacctgcaggcgctaccactaccgctagaggacggctggaccgtggacgcgtccaatttcgaggtcccctgctcttccccgcagccagcgccgcctccggtggatagggctaccgctaacgtcgccgccgacgcctcaagggcacccgtctacggctctcgcgcgacgagtttcatggcttggacgaggtcctcgcagcagtcgtcgtgctccgacgacgcggcgcccgcagcagtagtgccggccatcgaggagccgcagagattgctgaagaaagtggtggccggcggcggtgcttgggagagctgtggcggcgcgacgggagcagcacaggaaatgagtggcactggcaccaagaaccacgtcatgtcggagcgaaagcgacgagagaagctcaacgagatgttcctcgtcctcaagtcactgcttccgtccattcacagggtgaacaaagcgtcgatcctcgccgaaacgatagcctacctcaaggagcttcagagaagggtgcaagagctggagtccagtagggaacctgcgtcgcgcccatccgaaacgacgacaaggctaataacaaggccctcccgtggcaataatgagagtgtgaggaaggaggtctgcgcgggctccaagaggaagagcccagagctcggcagagacgacgtggagcgccccccggtcctcacgatggacgccggcaccagcaacgtcaccgtcaccgtctcggacaaggatgtgctcctggaggtgcagtgccggtgggaggagctcctgatgacgcgagtgttcgacgccatcaagagcctccatttggacgtcctctcggttcaggcttcagcgccagatggcttcatggggcttaagatacgagctcagtttgctggctccggtgccgtcgtgccctggatgatcagcgaggctcttcgcaaagctatagggaacccctgggtcgtcgtcgcgccggacaccggctcgcacgccaccccggccgcgacgtcgggcgcctgcgagacgggccagaatagcgccgctcatcgcgcggaccccgactcagccgggacgacgacgacctcggcggcggcggtgtgggcgcccaaggccgtgcggtgcacgggcggactcttcttcttccaccgggacacgacgccggcgcacgcgggcgagacggcgacgccaatggccggtggaggtggaggaggaggaggagaagcagggtcgtcggacgactgcagctcggcggcgtcggtatcgcttcgcgtcggaagccacgacgagccgtgcttctccggcgacggtgacggcgactggatggacgacgtgagggccctggcgtcgtttctggagtccgacgaggactggctccgctgtcagacggccgggcagcttgcgtagtggccaggtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggcgcgccggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 135 - DNA, 7853 bp, Artificial Sequence
  RV020636 + Chromosome Doubling (optional)
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgagctcggtacggccagaatggcccggaccgggttaccaagcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccagggcccggtgaccaatcgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaaacaacgtaagcgcttacgcaccgaacaacgtaagcgcttacgcaccgaacaacgtaagcgcttacgcacccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcacccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgaagccgaggccggccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggaccaccacctcacgccgacgccgccgccgccgccgccgccgatggggaactccgcggcgggggcgtcctcgaagccgccgacgccggcgtccacgcccaactcgcgcctcgcctcggcgccgtcctcccgccacgccgccacgccgccgcacgcgtcggcggcggcgtccgccccggcgccggcctcgcgcaccgtctacagcgaccgcttcatccccagccgcaccggatccaacctcgcgctcttcgacctcgccccctcgccctcctccgccgcctcgtcctcgcactcgcacgacgccggccccgcggcctcgtccggatctgcgcagcccgccgcgtcgccctactgcacgctcctccgcgccgcgctcttcggccccgacacgcccgaccgcgtcgcgtcctcggccgccgcgtgctcctcgtcgtcgtcctccttctccccggggccctcgcctgtcggcacccccgccaccgggaacatcttcagattcaagacggaggtgcgccggaacgccaagagggcgcttttttcgggagaccaagaggaggacgcgctgttccccggcattttcaccaccaggggcgcgggaccaaggaaggtgccaaggtcgccgtacaaggtgctggatgcgcccgctttgcaggacgacttctacctcaacctcgtcgattggtcttcacataacgtccttgctgtcgggttgggcaattgcgtttacttgtggaatgcatgcagcagcaaggtcaccaagctttgtgatttgggggtggatgacaatgtttgctctgtggggtgggcgcagcgcggcactcacctagctgtaggcacaaagcaaggaaaagttcagatctgggatgcaactcgttgtaaaagaataagaactatggaaagccatcgcatgcgtgtaggtgctcttgcatggagttcttctttgctttcttctggaagccgtgacaagagcatcctccaccatgatatccgtgctcaagaagattatgttagcaagcttaccgggcataaatctgaggtttgtggactcaagtggtcttatgacaatcgtcagcttgcatccggaggcaatgacaatggactttttgtttggaatccacattcagtacaaccagtactgaagtatactgagcacacagcagctgtcaaagctattgcctggtcacctcatctccacggcctgcttgcatctggtggaggaactgcagatagatgcatacgattctggaatacgaccacaaatacacacttgagttgtgtggacactggcagccaggtctgcaatcttgcgtggtcaaagaatgtgaatgagcttgttagcacccacgggtactcccagaaccagataattgtttggagatatccaacaatgtcgaagcttgccactttgacagggcacacgtaccgagtattgtatttagctatttcccctgacggccagaccatagttactggtgccggtgacgaaacactccgtttttggaacgtgttcccctctccaaagtcccagagctctgatagtctaagttgcatcgggggtacatcgtttgttagaagctacatccggtggccaggtaccactaactatctatactgtaataatgttgtatagccgccggatagctagctagtttagtcattcagcggcgatgggtaataataaagtgtcatccatccatcaccatgcgtggcaacgtgagcaatgacctgattgaacaaattgaaatgaaaagaagaaatatgttatatgtcaacgagatttcctcataatgccactgacgacgtgtgtccaagaaatgtatcagtgatacgtatattcacaatttttttatgacttatactcacaatttgtttttttactacttatactcacaatttgttgtgcgtaccataacaatttcgatcgaatatatatcagaaagttgacgaaagtaagctcactcaaaaagttaaatgggctgcggaagctgcgtcaggcccaagttttggctattctatccggtatccacgattttgatggctgagggacatatgttcgcttaagcttggcgcgccggtcacccggtccgggcctagaaggccagcttcggccgccccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 136 - DNA, 1587 bp, Zea mays
atggaccaccacctcacgccgacgccgccgccgccgccgccgccgatggggaactccgcggcgggggcgtcctcgaagccgccgacgccggcgtccacgcccaactcgcgcctcgcctcggcgccgtcctcccgccacgccgccacgccgccgcacgcgtcggcggcggcgtccgccccggcgccggcctcgcgcaccgtctacagcgaccgcttcatccccagccgcaccggatccaacctcgcgctcttcgacctcgccccctcgccctcctccgccgcctcgtcctcgcactcgcacgacgccggccccgcggcctcgtccggatctgcgcagcccgccgcgtcgccctactgcacgctcctccgcgccgcgctcttcggccccgacacgcccgaccgcgtcgcgtcctcggccgccgcgtgctcctcgtcgtcgtcctccttctccccggggccctcgcctgtcggcacccccgccaccgggaacatcttcagattcaagacggaggtgcgccggaacgccaagagggcgcttttttcgggagaccaagaggaggacgcgctgttccccggcattttcaccaccaggggcgcgggaccaaggaaggtgccaaggtcgccgtacaaggtgctggatgcgcccgctttgcaggacgacttctacctcaacctcgtcgattggtcttcacataacgtccttgctgtcgggttgggcaattgcgtttacttgtggaatgcatgcagcagcaaggtcaccaagctttgtgatttgggggtggatgacaatgtttgctctgtggggtgggcgcagcgcggcactcacctagctgtaggcacaaagcaaggaaaagttcagatctgggatgcaactcgttgtaaaagaataagaactatggaaagccatcgcatgcgtgtaggtgctcttgcatggagttcttctttgctttcttctggaagccgtgacaagagcatcctccaccatgatatccgtgctcaagaagattatgttagcaagcttaccgggcataaatctgaggtttgtggactcaagtggtcttatgacaatcgtcagcttgcatccggaggcaatgacaatggactttttgtttggaatccacattcagtacaaccagtactgaagtatactgagcacacagcagctgtcaaagctattgcctggtcacctcatctccacggcctgcttgcatctggtggaggaactgcagatagatgcatacgattctggaatacgaccacaaatacacacttgagttgtgtggacactggcagccaggtctgcaatcttgcgtggtcaaagaatgtgaatgagcttgttagcacccacgggtactcccagaaccagataattgtttggagatatccaacaatgtcgaagcttgccactttgacagggcacacgtaccgagtattgtatttagctatttcccctgacggccagaccatagttactggtgccggtgacgaaacactccgtttttggaacgtgttcccctctccaaagtcccagagctctgatagtctaagttgcatcgggggtacatcgtttgttagaagctacatccgg

SEQ ID NO: 137 - DNA, 1563 bp, Zea mays
atggatcaccaccgcacgccgatggagaactcggcgtcctcgaagccgccgacgccggcgtccacgcccaactcgcgcctcgcatcggcgccgtcaccccgccactccgccacgccgccgcacgcgtccgcgccggcgtccgccccggcgccggcctcgcgcaccgtctacagcgaccgcttcatccccagccgcgccggatccaacctcgcgctcttcgacctcggcccctcgccctcgcccgccgccgccgccgcctcctcgtcctcctcccacgaggccggccccgcggcctcgtccggatctgcgcccgccgcggcgtcgccctactgcgcgctcctccgcgccgcgctcttcgggcccgacacgcccgaccgggtcgcgtcctcggccgccgcgtgctcgtcctcctcctcctccccggggctctcgcctgtgggcacccccgccaccgggaacatcttcagattcaagacggaggtgcgccggaacgccaagagggcgcttttttccggaggggaggaggaggaggacgccctgttccccggcattttcaccaccaggggcgcgggaccaaggaaggtcccgaggtcgccctacaaggtgctggatgcgcctgcgttgcaggacgacttctacctcaacctcgtcgattggtcttcacataacgtcctcgctgttgggttgggcaattgcgtttacctgtggaatgcatgcagcagcaaggtcaccaagctttgcgatttgggggtggatgacaacgtttgttctgtggggtgggcgcagcgcggcactcaccttgcagtaggaacaaatcaaggaaaagttcagatctgggatgcaactcgctgtaaaagaataaggacaatggaaagccatcgcatgcgtgtaggtgctcttgcatggagttcttcgttgctttcttctggaagccgtgacaagagcatcctccaccatgatatccgtgctcaagaagatcatgttagcaagcttaccgggcataaatctgaggtttgtggactcaagtggtcttatgacaatcgtcagcttgcatcgggtggcaatgacaacagactttttgtttggaatccacattcagtacagccagtactgaagtatactgagcacacagcagctgtcaaagctattgcctggtcacctcatctccatgggctgcttgcatctggtggaggaactgcagatagatgcatacgattttggaatacgaccacaaatgcacacttgagctgtgtggacactggcagccaggtctgcaatctcgcgtggtcaaagaatgtaaatgagcttgttagcacccacggctactctcagaaccaaataattgtttggagatatccaacaatgtcgaagcttgccactttgacagggcatacatacagagtattgtacttagctatttcccctgatggccagaccatagttactggtgctggtgatgaaacgctccggttttggaacgtgttcccctctccaaagtcccagagttctgatagtttaagttgtgtcggaggaacatctttcgttagaagctacatccggtga

SEQ ID NO: 138 - DNA, 696 bp, Zea mays
atggaaagccatcgcatgcgtgtaggtgctcttgcatggagttcttcgttgctttcttctggaagccgtgacaagagcatcctccaccatgatatccgtgctcaagaagatcatgttagcaagcttaccgggcataaatctgaggtttgtggactcaagtggtcttatgacaatcgtcagcttgcatcgggtggcaatgacaacagacttttcgtttggaatccacattcagtacagccagtactgaagtatactgagcacacagcagctgtcaaagctattgcctggtcacctcatctccatgggctgcttgcatctggtggaggaactgcagatagatgcatacgattttggaatacgaccacaaatgcacacttgagctgtgtggacactggcagccaggtctgcaatcttgcgtggtcaaagaatgtaaatgagcttgttagcacccacggctactctcagaaccaaataattgtttggagatatccaacaatgtcgaagcttgccactttgacagggcatacatacagagtattgtacttagctatttcccctgatggccagaccatagttactggtgctggtgatgaaacgctccggttttggaacgtgttcccctctccaaagtcccagagttctgacagtttaagttgcgtcggaggaacatctttcgttagaagctacatccggtga

SEQ ID NO: 139 - DNA, 1458 bp, Zea mays
atggcggtggcggcgccggcctcggacgccaagccgcgcctcaacgtgccaccgtccatggcatccgcgctccgcctcgatcccgtggggctgggggcgggaccctctatgccgtccccctcccgccgactcgccgagcctcccaagacgccctccccatccaagaccacctacagcgaccgtttcatcccctgccgctcctcctcccgcctccagaacttcgcgctaatcgactcccctctctccccagccaaggacgacacgccctactcccgcctcctccgcgccgagctctttggccccgattcacccaaacccaccaccgccacctccgcagcctccgcctcgcccaacaccaacctcttccgcttcaagaaagaccactccgctcccacctcacccttcgctaaagctgccgccgcgcaccatgactgcaccgcgggatccggagacgcgccgtcgccgcagaagccacccaggaaggtccccaaaacgccgcataaggtcctggacgcgccctccctgcaggacgacttctatctcaacctcgtcgactggtcctcgcagaacgtgctcgccgtcggcctcggcacctgcgtctacctctggtccgcgtccaatagcaaggtcaccaagctctgcgatttggggcctagggacagcgtatgcgccgtgcattggtcacgggaaggctcttatctttccattggcaccggccttggagatgtccagatttgggatagttctcgctgtaagcggattagaaatatgggaggtcaccaaacaaggactggggtattagcatggagctcatgcatcttgtcgtcgggtagcagggacaagaacatactgcagcatgacatccgtgtccccaatgactatatcagcaagttttctggtcatagatcagaggtttgtggactcgaatggtcgcatgacgaccgcgagcttgcctcaggcggaaatgacaaccagttattagtctggaaccaacgatcgcaacagccagttttgcggttgacagaacatacagctgctgttaaagcaatagcgtggtcaccacatcagcaaggactcctagcatcaggaggtggaacagctgatagatgcatcaggttttggaacacggctaacggaaatgttctgaactcaattgacacaggcagccaggtttgcaaccttgcctggtgcaaaaatgtgaatgagcttgtgagcacacatggatattcccaaaatcagatcatggtgtggaaatacccatccatgtcaaaggttgcaactctaactggacatacgatgcgtgtgctttacctcgcgtcgtcgcctgatggacagaccatagtaacaggggcaggtgacgaaactctacggttctggaacatatttccatcagttagaacacagactcctgtgcgtgatattgggctctcgtcattctcaagaagccacatccggtga

SEQ ID NO: 140 - DNA, 855 bp, Artificial Sequence
  Mutated B-tubulin-PS00227minus
atgcgcgaaattctgcatattcagggcggccagtgcggcaaccagattggcagcaaattttgggaagtggtgtgcgatgaacatggcattgatccgaccggccgctatatgggcaccagcgatgtgcagctggaacgcgtgaacgtgtattataacgaagcgagctgcggccgctttgtgccgcgcgcggtgctgatggatctggaaccgggcaccatggatgcggtgcgcaccggcccgtatggccagatttttcgcccggataactttgtgtttggccagagcggcgcgggcaacaactgggcgaaaggccattataccgaaggcgcggaactgattgatagcgtgctggatgtggtgcgcaaagaagcggaaaactgcgattgcctgcagggctttcaggtgtgccatagcctgcacgctggacaccgggaggcaatgcgcgaaattctgcatattcagggcggccagtgcggcaaccagattggcagcaaattttgggaagtggtgtgcgatgaacatggcattgatccgaccggccgctatatgggcaccagcgatgtgcagctggaacgcgtgaacgtgtattataacgaagcgagctgcggccgctttgtgccgcgcgcggtgctgatggatctggaaccgggcaccatggatgcggtgcgcaccggcccgtatggccagatttttcgcccggataactttgtgtttggccagagcggcgcgggcaacaactgggcgaaaggccattataccgaaggcgcggaactgattgatagcgtgctggatgtggtgcgcaaagaagcggaaaactgcgattgcctgcagggctttcaggtgtgccatagcctg

SEQ ID NO: 141 - protein, 285 aa, Artificial Sequence
  Mutated B-tubulin-PS00227minus
MREILHIQGGQCGNQIGSKFWEVVCDEHGIDPTGRYMGTSDVQLERVNVYYNEASCGRFVPRAVLMDLEPGTMDAVRTGPYGQIFRPDNFVFGQSGAGNNWAKGHYTEGAELIDSVLDVVRKEAENCDCLQGFQVCHSLHAGHREAMREILHIQGGQCGNQIGSKFWEVVCDEHGIDPTGRYMGTSDVQLERVNVYYNEASCGRFVPRAVLMDLEPGTMDAVRTGPYGQIFRPDNFVFGQSGAGNNWAKGHYTEGAELIDSVLDVVRKEAENCDCLQGFQVCHSL

SEQ ID NO: 142 - DNA, 3220 bp, Artificial Sequence
  B-tubulin "PS00227 minus" expression cassette
atccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtagatgcgcgaaattctgcatattcagggcggccagtgcggcaaccagattggcagcaaattttgggaagtggtgtgcgatgaacatggcattgatccgaccggccgctatatgggcaccagcgatgtgcagctggaacgcgtgaacgtgtattataacgaagcgagctgcggccgctttgtgccgcgcgcggtgctgatggatctggaaccgggcaccatggatgcggtgcgcaccggcccgtatggccagatttttcgcccggataactttgtgtttggccagagcggcgcgggcaacaactgggcgaaaggccattataccgaaggcgcggaactgattgatagcgtgctggatgtggtgcgcaaagaagcggaaaactgcgattgcctgcagggctttcaggtgtgccatagcctgcacgctggacaccgggaggcaatgcgcgaaattctgcatattcagggcggccagtgcggcaaccagattggcagcaaattttgggaagtggtgtgcgatgaacatggcattgatccgaccggccgctatatgggcaccagcgatgtgcagctggaacgcgtgaacgtgtattataacgaagcgagctgcggccgctttgtgccgcgcgcggtgctgatggatctggaaccgggcaccatggatgcggtgcgcaccggcccgtatggccagatttttcgcccggataactttgtgtttggccagagcggcgcgggcaacaactgggcgaaaggccattataccgaaggcgcggaactgattgatagcgtgctggatgtggtgcgcaaagaagcggaaaactgcgattgcctgcagggctttcaggtgtgccatagcctggtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagct

SEQ ID NO: 143 - DNA, 963 bp, Artificial Sequence
  B-TUBULIN "PS00227 MINUS"-VIRF-C36
atgcgcgaaattctgcatattcagggcggccagtgcggcaaccagattggcagcaaattttgggaagtggtgtgcgatgaacatggcattgatccgaccggccgctatatgggcaccagcgatgtgcagctggaacgcgtgaacgtgtattataacgaagcgagctgcggccgctttgtgccgcgcgcggtgctgatggatctggaaccgggcaccatggatgcggtgcgcaccggcccgtatggccagatttttcgcccggataactttgtgtttggccagagcggcgcgggcaacaactgggcgaaaggccattataccgaaggcgcggaactgattgatagcgtgctggatgtggtgcgcaaagaagcggaaaactgcgattgcctgcagggctttcaggtgtgccatagcctgcacgctggacaccgggaggcaatgcgcgaaattctgcatattcagggcggccagtgcggcaaccagattggcagcaaattttgggaagtggtgtgcgatgaacatggcattgatccgaccggccgctatatgggcaccagcgatgtgcagctggaacgcgtgaacgtgtattataacgaagcgagctgcggccgctttgtgccgcgcgcggtgctgatggatctggaaccgggcaccatggatgcggtgcgcaccggcccgtatggccagatttttcgcccggataactttgtgtttggccagagcggcgcgggcaacaactgggcgaaaggccattataccgaaggcgcggaactgattgatagcgtgctggatgtggtgcgcaaagaagcggaaaactgcgattgcctgcagggctttcaggtgtgccatagcctggaagttatggcggaggttcggccaatagcccggagcataaagacggcccacgacgacgcaagggcagaacttatgtctgccgatagaccacgctcaacacgcggactg

SEQ ID NO: 144 - protein, 321 aa, Artificial Sequence
  B-tubulin "PS00227 minus"-virF-C36
MREILHIQGGQCGNQIGSKFWEVVCDEHGIDPTGRYMGTSDVQLERVNVYYNEASCGRFVPRAVLMDLEPGTMDAVRTGPYGQIFRPDNFVFGQSGAGNNWAKGHYTEGAELIDSVLDVVRKEAENCDCLQGFQVCHSLHAGHREAMREILHIQGGQCGNQIGSKFWEVVCDEHGIDPTGRYMGTSDVQLERVNVYYNEASCGRFVPRAVLMDLEPGTMDAVRTGPYGQIFRPDNFVFGQSGAGNNWAKGHYTEGAELIDSVLDVVRKEAENCDCLQGFQVCHSLEVMAEVRPIARSIKTAHDDARAELMSADRPRSTRGL

SEQ ID NO: 145 - DNA, 936 bp, Artificial Sequence
  B-TUBULIN "PS00227 MINUS"-GALLS-C26
atgcgcgaaattctgcatattcagggcggccagtgcggcaaccagattggcagcaaattttgggaagtggtgtgcgatgaacatggcattgatccgaccggccgctatatgggcaccagcgatgtgcagctggaacgcgtgaacgtgtattataacgaagcgagctgcggccgctttgtgccgcgcgcggtgctgatggatctggaaccgggcaccatggatgcggtgcgcaccggcccgtatggccagatttttcgcccggataactttgtgtttggccagagcggcgcgggcaacaactgggcgaaaggccattataccgaaggcgcggaactgattgatagcgtgctggatgtggtgcgcaaagaagcggaaaactgcgattgcctgcagggctttcaggtgtgccatagcctgcacgctggacaccgggaggcaatgcgcgaaattctgcatattcagggcggccagtgcggcaaccagattggcagcaaattttgggaagtggtgtgcgatgaacatggcattgatccgaccggccgctatatgggcaccagcgatgtgcagctggaacgcgtgaacgtgtattataacgaagcgagctgcggccgctttgtgccgcgcgcggtgctgatggatctggaaccgggcaccatggatgcggtgcgcaccggcccgtatggccagatttttcgcccggataactttgtgtttggccagagcggcgcgggcaacaactgggcgaaaggccattataccgaaggcgcggaactgattgatagcgtgctggatgtggtgcgcaaagaagcggaaaactgcgattgcctgcagggctttcaggtgtgccatagcctgccgaaagcggccaatgatgtggatcggttgacacgggacttcgatgagcggatacgggttagaggcgacggcagggggctg

SEQ ID NO: 146 - protein, 312 aa, Artificial Sequence
  B-Tubulin "Ps00227 Minus"-Galls-C26
MREILHIQGGQCGNQIGSKFWEVVCDEHGIDPTGRYMGTSDVQLERVNVYYNEASCGRFVPRAVLMDLEPGTMDAVRTGPYGQIFRPDNFVFGQSGAGNNWAKGHYTEGAELIDSVLDVVRKEAENCDCLQGFQVCHSLHAGHREAMREILHIQGGQCGNQIGSKFWEVVCDEHGIDPTGRYMGTSDVQLERVNVYYNEASCGRFVPRAVLMDLEPGTMDAVRTGPYGQIFRPDNFVFGQSGAGNNWAKGHYTEGAELIDSVLDVVRKEAENCDCLQGFQVCHSLPKAANDVDRLTRDFDERIRVRGDGRGL

SEQ ID NO: 147 - DNA, 34 bp, Bacteriophage P1
ataacttcgtatagcatacattatacgaagttat

SEQ ID NO: 148 - DNA, 7260 bp, Artificial Sequence
  TaEC PRO::dCas9-CBF1A
gatctgaggtcgactctagctggtgctaccgagtgaggaggctgacgtactactacttatcatagcaagtaaccgaaacgtcaggtaagcgaaaaggctttacgagaacgtggaagtccaaacgaatcaaaattatcttaattaaacgcgaatgcgttgccccttcctctccttcctacgttactctatccacagaaaattaatcggggcgtgatcccctcgtttctcatctccccccaaaatcccctttctttcatggtacgagtagttgaggcctcttttggttcataggataaaattatcgtaggaatatgaattttataggaaatgagatgatatgtatctcaaatcctatgagtaggaataggaaacgagatgtcatttggttgacaccaaaggaatttttccattgagtctaggtttatttttattttcctattaaatatgaaggataggaaccaatcctatgtagaaataggaatccattcctatgaaccaaatggctctataggaaaaaaatcctataagaatcctatcatctagaattcctatgaaattcctccaaaccaaaggagtacgtgaaaagtatcaccttctttgaattttgatgcctaattatttagctctggtattgagaaagaaaccattcatacggccaggtcacaggaatgcttcttcggcttacaattccgagtcaacaaccgtaactcagcacttagccctagttcttgctctttccttccttgcaacgggctgcagaaaaagtaggaaaatggactgaaattgttggataagtggatttgcggtatctcaacaatcagaacagcgaatgttccatcatccaaactaagcttcctcagatcctaaccccgcctggacaattagacagccaacccgtaatcgcaacgacccaattgcaagagcggagctctaccaactgagctatatcccccccgagccaagtggagtatgcatggagtcctctacaacgtagtacgaatttgcacaacttcagagatactagtactagttttgacagtgcgcaagatttttgagttaacacatgctacatgagacacacggacaaatcttgaaggctcaaatcgagcctccaagtcattgggcagctacagtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaacctgcgccaaggacatccagaaagcagccgccgaagcggccctcgccttccaagacgagacgtgcgatacaaccaccacgaatcatggcctcgatatggaggaaacgatggtcgaagccatctacaccccagagcagtcagaaggcgccttctacatggacgaggaaaccatgttcggcatgccgaccctcctcgacaacatggccgaaggaatgctcctcccacctccctcagttcagtggaaccacaactacgacggcgaaggcgacggagacgtttccctgtggagctactaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 149 - DNA, 7407 bp, Artificial Sequence
  TaEC PRO::dCas9-GNAT1
gatctgaggtcgactctagctggtgctaccgagtgaggaggctgacgtactactacttatcatagcaagtaaccgaaacgtcaggtaagcgaaaaggctttacgagaacgtggaagtccaaacgaatcaaaattatcttaattaaacgcgaatgcgttgccccttcctctccttcctacgttactctatccacagaaaattaatcggggcgtgatcccctcgtttctcatctccccccaaaatcccctttctttcatggtacgagtagttgaggcctcttttggttcataggataaaattatcgtaggaatatgaattttataggaaatgagatgatatgtatctcaaatcctatgagtaggaataggaaacgagatgtcatttggttgacaccaaaggaatttttccattgagtctaggtttatttttattttcctattaaatatgaaggataggaaccaatcctatgtagaaataggaatccattcctatgaaccaaatggctctataggaaaaaaatcctataagaatcctatcatctagaattcctatgaaattcctccaaaccaaaggagtacgtgaaaagtatcaccttctttgaattttgatgcctaattatttagctctggtattgagaaagaaaccattcatacggccaggtcacaggaatgcttcttcggcttacaattccgagtcaacaaccgtaactcagcacttagccctagttcttgctctttccttccttgcaacgggctgcagaaaaagtaggaaaatggactgaaattgttggataagtggatttgcggtatctcaacaatcagaacagcgaatgttccatcatccaaactaagcttcctcagatcctaaccccgcctggacaattagacagccaacccgtaatcgcaacgacccaattgcaagagcggagctctaccaactgagctatatcccccccgagccaagtggagtatgcatggagtcctctacaacgtagtacgaatttgcacaacttcagagatactagtactagttttgacagtgcgcaagatttttgagttaacacatgctacatgagacacacggacaaatcttgaaggctcaaatcgagcctccaagtcattgggcagctacagtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgacttgccttgtggccgtcaattctaattctgtaaatagtagtttcaacatcgagtgtggagatgctacagatgccaactttgagaaatacaatctcagtagaggctccgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 150 - DNA, 7410 bp, Artificial Sequence
  TaEC PRO::dCas9-GNAT2
gatctgaggtcgactctagctggtgctaccgagtgaggaggctgacgtactactacttatcatagcaagtaaccgaaacgtcaggtaagcgaaaaggctttacgagaacgtggaagtccaaacgaatcaaaattatcttaattaaacgcgaatgcgttgccccttcctctccttcctacgttactctatccacagaaaattaatcggggcgtgatcccctcgtttctcatctccccccaaaatcccctttctttcatggtacgagtagttgaggcctcttttggttcataggataaaattatcgtaggaatatgaattttataggaaatgagatgatatgtatctcaaatcctatgagtaggaataggaaacgagatgtcatttggttgacaccaaaggaatttttccattgagtctaggtttatttttattttcctattaaatatgaaggataggaaccaatcctatgtagaaataggaatccattcctatgaaccaaatggctctataggaaaaaaatcctataagaatcctatcatctagaattcctatgaaattcctccaaaccaaaggagtacgtgaaaagtatcaccttctttgaattttgatgcctaattatttagctctggtattgagaaagaaaccattcatacggccaggtcacaggaatgcttcttcggcttacaattccgagtcaacaaccgtaactcagcacttagccctagttcttgctctttccttccttgcaacgggctgcagaaaaagtaggaaaatggactgaaattgttggataagtggatttgcggtatctcaacaatcagaacagcgaatgttccatcatccaaactaagcttcctcagatcctaaccccgcctggacaattagacagccaacccgtaatcgcaacgacccaattgcaagagcggagctctaccaactgagctatatcccccccgagccaagtggagtatgcatggagtcctctacaacgtagtacgaatttgcacaacttcagagatactagtactagttttgacagtgcgcaagatttttgagttaacacatgctacatgagacacacggacaaatcttgaaggctcaaatcgagcctccaagtcattgggcagctacagtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgaatgacggcgttgatgaacacatgatatggttggtagggttgaagaatatcttcgcccgacagcttcctaatatgcccaaagaatatattgtacgccttgtcatggatagaactcacaagtcaatgatggttatcaggaacaatattgtcgtggggggcattacttatcgcccttatgcaagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcagggtttcacaaaggagatcacattggacaaagaaagatggcaagggtacattaaagattatgacggaggaatattgatggagtgtaaaattgacgcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 151 - DNA, 8118 bp, Artificial Sequence
  TaEC PRO::dCas9-HAT1
gatctgaggtcgactctagctggtgctaccgagtgaggaggctgacgtactactacttatcatagcaagtaaccgaaacgtcaggtaagcgaaaaggctttacgagaacgtggaagtccaaacgaatcaaaattatcttaattaaacgcgaatgcgttgccccttcctctccttcctacgttactctatccacagaaaattaatcggggcgtgatcccctcgtttctcatctccccccaaaatcccctttctttcatggtacgagtagttgaggcctcttttggttcataggataaaattatcgtaggaatatgaattttataggaaatgagatgatatgtatctcaaatcctatgagtaggaataggaaacgagatgtcatttggttgacaccaaaggaatttttccattgagtctaggtttatttttattttcctattaaatatgaaggataggaaccaatcctatgtagaaataggaatccattcctatgaaccaaatggctctataggaaaaaaatcctataagaatcctatcatctagaattcctatgaaattcctccaaaccaaaggagtacgtgaaaagtatcaccttctttgaattttgatgcctaattatttagctctggtattgagaaagaaaccattcatacggccaggtcacaggaatgcttcttcggcttacaattccgagtcaacaaccgtaactcagcacttagccctagttcttgctctttccttccttgcaacgggctgcagaaaaagtaggaaaatggactgaaattgttggataagtggatttgcggtatctcaacaatcagaacagcgaatgttccatcatccaaactaagcttcctcagatcctaaccccgcctggacaattagacagccaacccgtaatcgcaacgacccaattgcaagagcggagctctaccaactgagctatatcccccccgagccaagtggagtatgcatggagtcctctacaacgtagtacgaatttgcacaacttcagagatactagtactagttttgacagtgcgcaagatttttgagttaacacatgctacatgagacacacggacaaatcttgaaggctcaaatcgagcctccaagtcattgggcagctacagtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatggaggtgggcacgcgcgtgatgtgccggtggcgcgaccagaagctccacccggtcaaggtgatcgagcgccgcaagggctccgcgtgctcttcccccgccgactacgagtattacgtccactacaccgagttcaatagaagacttgacgagtgggttaagcttgatcagcttgatcttgacactgtcgagaccgttgtcgatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatatcgcgaagatcgaactggggagatatgagatagacacatggtatttctctccttttccaccagagtataatgactgcccgaagctgtttttctgtgaattttgcctcaacttcatgaagcgcaaagaacagcttcagaggcacatgaagaagtgtgatcttaagcaccccccaggtgatgaaatctatagaagtggaactctatcaatgttcgaggttgatgggaagaagaacaaggtttatggacagaacctttgttatctggctaagctatttcttgatcacaagacattgtactatgatgttgatttgttcttgttttatgtcctctgcgaatgtgatgatcggggatgtcatatggtgggatatttctctaaggaaaaacactccgaagaatcttataatttggcttgcattctcactctccccccataccaaagaaaaggatatgggaagttcctgattgctttctcatatgaactttccaagaaagaaggtaaagttgggacaccggagcgccctctctctgatcttggtctgctcagctatagaggttattggactagagtgcttctggaaattctaaagaaacataagggaaacatatctataaaggaactaagcgacatgacggcaataaaagcagatgacatattgagcacgctacagagcctggacctaatccagtaccgcaaagggcagcacgtcatctgcgctgacccgaaggtcctcgaccgccacctcaaggcggcggggcggggcggcctggacgtcgacgttagcaagctcatatggactccctacaaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 152 - DNA, 8334 bp, Artificial Sequence
  TaEC PRO::dCas9-HAT2
gatctgaggtcgactctagctggtgctaccgagtgaggaggctgacgtactactacttatcatagcaagtaaccgaaacgtcaggtaagcgaaaaggctttacgagaacgtggaagtccaaacgaatcaaaattatcttaattaaacgcgaatgcgttgccccttcctctccttcctacgttactctatccacagaaaattaatcggggcgtgatcccctcgtttctcatctccccccaaaatcccctttctttcatggtacgagtagttgaggcctcttttggttcataggataaaattatcgtaggaatatgaattttataggaaatgagatgatatgtatctcaaatcctatgagtaggaataggaaacgagatgtcatttggttgacaccaaaggaatttttccattgagtctaggtttatttttattttcctattaaatatgaaggataggaaccaatcctatgtagaaataggaatccattcctatgaaccaaatggctctataggaaaaaaatcctataagaatcctatcatctagaattcctatgaaattcctccaaaccaaaggagtacgtgaaaagtatcaccttctttgaattttgatgcctaattatttagctctggtattgagaaagaaaccattcatacggccaggtcacaggaatgcttcttcggcttacaattccgagtcaacaaccgtaactcagcacttagccctagttcttgctctttccttccttgcaacgggctgcagaaaaagtaggaaaatggactgaaattgttggataagtggatttgcggtatctcaacaatcagaacagcgaatgttccatcatccaaactaagcttcctcagatcctaaccccgcctggacaattagacagccaacccgtaatcgcaacgacccaattgcaagagcggagctctaccaactgagctatatcccccccgagccaagtggagtatgcatggagtcctctacaacgtagtacgaatttgcacaacttcagagatactagtactagttttgacagtgcgcaagatttttgagttaacacatgctacatgagacacacggacaaatcttgaaggctcaaatcgagcctccaagtcattgggcagctacagtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcagcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 153 - DNA, 7140 bp, Artificial Sequence
  TaEC PRO::dCAS9-jmj
gatctgaggtcgactctagctggtgctaccgagtgaggaggctgacgtactactacttatcatagcaagtaaccgaaacgtcaggtaagcgaaaaggctttacgagaacgtggaagtccaaacgaatcaaaattatcttaattaaacgcgaatgcgttgccccttcctctccttcctacgttactctatccacagaaaattaatcggggcgtgatcccctcgtttctcatctccccccaaaatcccctttctttcatggtacgagtagttgaggcctcttttggttcataggataaaattatcgtaggaatatgaattttataggaaatgagatgatatgtatctcaaatcctatgagtaggaataggaaacgagatgtcatttggttgacaccaaaggaatttttccattgagtctaggtttatttttattttcctattaaatatgaaggataggaaccaatcctatgtagaaataggaatccattcctatgaaccaaatggctctataggaaaaaaatcctataagaatcctatcatctagaattcctatgaaattcctccaaaccaaaggagtacgtgaaaagtatcaccttctttgaattttgatgcctaattatttagctctggtattgagaaagaaaccattcatacggccaggtcacaggaatgcttcttcggcttacaattccgagtcaacaaccgtaactcagcacttagccctagttcttgctctttccttccttgcaacgggctgcagaaaaagtaggaaaatggactgaaattgttggataagtggatttgcggtatctcaacaatcagaacagcgaatgttccatcatccaaactaagcttcctcagatcctaaccccgcctggacaattagacagccaacccgtaatcgcaacgacccaattgcaagagcggagctctaccaactgagctatatcccccccgagccaagtggagtatgcatggagtcctctacaacgtagtacgaatttgcacaacttcagagatactagtactagttttgacagtgcgcaagatttttgagttaacacatgctacatgagacacacggacaaatcttgaaggctcaaatcgagcctccaagtcattgggcagctacagtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaagtggcctttcaaatactaaatgaaaagacaactgtcttgtctcctgaagtgcttctttctgctggagttccttgctgcagattggttcaaaaccctggtgaatttgttatcacattccctggagcttatcattctggttttagccatggatttaattgtggagaagcaacaaacattgcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 154 - DNA, 7627 bp, Artificial Sequence
  ZmEC1 PRO-V3::dCas9-CBF1A
gtgatctaagaccagtgaagacttgggatgatgaatggagctcaggagatactatgcgctagttggtttgtatagctgaggctcgcgactgtacttatagaaggtgcaggcggacactgcaggcaagccaagagtcacaaactcacaattagtttcagaatgtgtaaagccacgtttttaatctccctctctctaatggaaaataagtgggctttactgccacagtgacactaccgcactaatgtaaagttccaccgtgccatggagccacggcacttcaacggacacaacataagtcatgcctgctcattttccaaatttgtgtgttttgattttaacccccagggtgttttgcacgtcagttcgatttttaaccttgaactttaaaactgaataccgaacgagtcctccttactggttttcaaaggtcgttttttttaaaaaaaaacttgatagctaatttacaaggcatgcaaaaacaaatagttttcctttgtgcgaggaagtttaaatactactgtataatttacgggaccgagggactacaaggcatctcagcaagtcagagtcatttcctggtatatgtaccaagttcttctacatcaagtcagtgctcattgactaattatgtgtttggtttgagatcaaaataggatgagacggggataacaccgttctctcgatttttttggatcatgctgtcataaaaaattacttcggtgttcatctcgttctcgtgtgactctcatccaaatgttatagaaaatgtggccgccctctttgatcccttcttatacgtacaaccaaacacacgttaaaagatggattgaataattgaccgtgtataactgttataacacatgttctttaggcactgataattgcacaaacagaaaagacacgatcccctccgaggcaggcccaacccccagctcacagggtcacagctgtggattagactttgtacactgctgcccatgtctccagctaaactgaaaggttcacctgtacttgagtacttctgttggctggactttctaagatatagtgaaaccaagaatgtatctatgatctatcatgaaatgacaacattaccaggttcaaaattttgaacaagagaagaagctgctgtttgactcagcccgactactttagaacacatcattacatttggactaaacctaccagttctgatagccagattgtgccattctaggaatacgtctgatggtgcaccgagactttggagtacattcaacaagaggcccaacgaaacacttttgaaggctcaatctatagcctcatcagactatatacagacaatgcaaaaccacaaaactaataacagcgacacgggcaatgttaggtgcaaagaagtggcggcagaaacgtgaattgtgagaggaaacaaacaattgtcgacagatggatcgacagtagttatcaaacctaggccattgaagtagcaactatcctcactctgatcatctgctggtagtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaacctgcgccaaggacatccagaaagcagccgccgaagcggccctcgccttccaagacgagacgtgcgatacaaccaccacgaatcatggcctcgatatggaggaaacgatggtcgaagccatctacaccccagagcagtcagaaggcgccttctacatggacgaggaaaccatgttcggcatgccgaccctcctcgacaacatggccgaaggaatgctcctcccacctccctcagttcagtggaaccacaactacgacggcgaaggcgacggagacgtttccctgtggagctactaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 155 - DNA, 7774 bp, Artificial Sequence
  ZmEC1 PRO-V3::dCas9-GNAT1
gtgatctaagaccagtgaagacttgggatgatgaatggagctcaggagatactatgcgctagttggtttgtatagctgaggctcgcgactgtacttatagaaggtgcaggcggacactgcaggcaagccaagagtcacaaactcacaattagtttcagaatgtgtaaagccacgtttttaatctccctctctctaatggaaaataagtgggctttactgccacagtgacactaccgcactaatgtaaagttccaccgtgccatggagccacggcacttcaacggacacaacataagtcatgcctgctcattttccaaatttgtgtgttttgattttaacccccagggtgttttgcacgtcagttcgatttttaaccttgaactttaaaactgaataccgaacgagtcctccttactggttttcaaaggtcgttttttttaaaaaaaaacttgatagctaatttacaaggcatgcaaaaacaaatagttttcctttgtgcgaggaagtttaaatactactgtataatttacgggaccgagggactacaaggcatctcagcaagtcagagtcatttcctggtatatgtaccaagttcttctacatcaagtcagtgctcattgactaattatgtgtttggtttgagatcaaaataggatgagacggggataacaccgttctctcgatttttttggatcatgctgtcataaaaaattacttcggtgttcatctcgttctcgtgtgactctcatccaaatgttatagaaaatgtggccgccctctttgatcccttcttatacgtacaaccaaacacacgttaaaagatggattgaataattgaccgtgtataactgttataacacatgttctttaggcactgataattgcacaaacagaaaagacacgatcccctccgaggcaggcccaacccccagctcacagggtcacagctgtggattagactttgtacactgctgcccatgtctccagctaaactgaaaggttcacctgtacttgagtacttctgttggctggactttctaagatatagtgaaaccaagaatgtatctatgatctatcatgaaatgacaacattaccaggttcaaaattttgaacaagagaagaagctgctgtttgactcagcccgactactttagaacacatcattacatttggactaaacctaccagttctgatagccagattgtgccattctaggaatacgtctgatggtgcaccgagactttggagtacattcaacaagaggcccaacgaaacacttttgaaggctcaatctatagcctcatcagactatatacagacaatgcaaaaccacaaaactaataacagcgacacgggcaatgttaggtgcaaagaagtggcggcagaaacgtgaattgtgagaggaaacaaacaattgtcgacagatggatcgacagtagttatcaaacctaggccattgaagtagcaactatcctcactctgatcatctgctggtagtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgacttgccttgtggccgtcaattctaattctgtaaatagtagtttcaacatcgagtgtggagatgctacagatgccaactttgagaaatacaatctcagtagaggctccgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 156 - DNA, 7777 bp, Artificial Sequence
  ZmEC1 PRO-V3::dCas9-GNAT2
gtgatctaagaccagtgaagacttgggatgatgaatggagctcaggagatactatgcgctagttggtttgtatagctgaggctcgcgactgtacttatagaaggtgcaggcggacactgcaggcaagccaagagtcacaaactcacaattagtttcagaatgtgtaaagccacgtttttaatctccctctctctaatggaaaataagtgggctttactgccacagtgacactaccgcactaatgtaaagttccaccgtgccatggagccacggcacttcaacggacacaacataagtcatgcctgctcattttccaaatttgtgtgttttgattttaacccccagggtgttttgcacgtcagttcgatttttaaccttgaactttaaaactgaataccgaacgagtcctccttactggttttcaaaggtcgttttttttaaaaaaaaacttgatagctaatttacaaggcatgcaaaaacaaatagttttcctttgtgcgaggaagtttaaatactactgtataatttacgggaccgagggactacaaggcatctcagcaagtcagagtcatttcctggtatatgtaccaagttcttctacatcaagtcagtgctcattgactaattatgtgtttggtttgagatcaaaataggatgagacggggataacaccgttctctcgatttttttggatcatgctgtcataaaaaattacttcggtgttcatctcgttctcgtgtgactctcatccaaatgttatagaaaatgtggccgccctctttgatcccttcttatacgtacaaccaaacacacgttaaaagatggattgaataattgaccgtgtataactgttataacacatgttctttaggcactgataattgcacaaacagaaaagacacgatcccctccgaggcaggcccaacccccagctcacagggtcacagctgtggattagactttgtacactgctgcccatgtctccagctaaactgaaaggttcacctgtacttgagtacttctgttggctggactttctaagatatagtgaaaccaagaatgtatctatgatctatcatgaaatgacaacattaccaggttcaaaattttgaacaagagaagaagctgctgtttgactcagcccgactactttagaacacatcattacatttggactaaacctaccagttctgatagccagattgtgccattctaggaatacgtctgatggtgcaccgagactttggagtacattcaacaagaggcccaacgaaacacttttgaaggctcaatctatagcctcatcagactatatacagacaatgcaaaaccacaaaactaataacagcgacacgggcaatgttaggtgcaaagaagtggcggcagaaacgtgaattgtgagaggaaacaaacaattgtcgacagatggatcgacagtagttatcaaacctaggccattgaagtagcaactatcctcactctgatcatctgctggtagtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgaatgacggcgttgatgaacacatgatatggttggtagggttgaagaatatcttcgcccgacagcttcctaatatgcccaaagaatatattgtacgccttgtcatggatagaactcacaagtcaatgatggttatcaggaacaatattgtcgtggggggcattacttatcgcccttatgcaagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcagggtttcacaaaggagatcacattggacaaagaaagatggcaagggtacattaaagattatgacggaggaatattgatggagtgtaaaattgacgcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 157 - DNA, 8485 bp, Artificial Sequence
  ZmEC1 PRO-V3::dCas9-HAT1
gtgatctaagaccagtgaagacttgggatgatgaatggagctcaggagatactatgcgctagttggtttgtatagctgaggctcgcgactgtacttatagaaggtgcaggcggacactgcaggcaagccaagagtcacaaactcacaattagtttcagaatgtgtaaagccacgtttttaatctccctctctctaatggaaaataagtgggctttactgccacagtgacactaccgcactaatgtaaagttccaccgtgccatggagccacggcacttcaacggacacaacataagtcatgcctgctcattttccaaatttgtgtgttttgattttaacccccagggtgttttgcacgtcagttcgatttttaaccttgaactttaaaactgaataccgaacgagtcctccttactggttttcaaaggtcgttttttttaaaaaaaaacttgatagctaatttacaaggcatgcaaaaacaaatagttttcctttgtgcgaggaagtttaaatactactgtataatttacgggaccgagggactacaaggcatctcagcaagtcagagtcatttcctggtatatgtaccaagttcttctacatcaagtcagtgctcattgactaattatgtgtttggtttgagatcaaaataggatgagacggggataacaccgttctctcgatttttttggatcatgctgtcataaaaaattacttcggtgttcatctcgttctcgtgtgactctcatccaaatgttatagaaaatgtggccgccctctttgatcccttcttatacgtacaaccaaacacacgttaaaagatggattgaataattgaccgtgtataactgttataacacatgttctttaggcactgataattgcacaaacagaaaagacacgatcccctccgaggcaggcccaacccccagctcacagggtcacagctgtggattagactttgtacactgctgcccatgtctccagctaaactgaaaggttcacctgtacttgagtacttctgttggctggactttctaagatatagtgaaaccaagaatgtatctatgatctatcatgaaatgacaacattaccaggttcaaaattttgaacaagagaagaagctgctgtttgactcagcccgactactttagaacacatcattacatttggactaaacctaccagttctgatagccagattgtgccattctaggaatacgtctgatggtgcaccgagactttggagtacattcaacaagaggcccaacgaaacacttttgaaggctcaatctatagcctcatcagactatatacagacaatgcaaaaccacaaaactaataacagcgacacgggcaatgttaggtgcaaagaagtggcggcagaaacgtgaattgtgagaggaaacaaacaattgtcgacagatggatcgacagtagttatcaaacctaggccattgaagtagcaactatcctcactctgatcatctgctggtagtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatggaggtgggcacgcgcgtgatgtgccggtggcgcgaccagaagctccacccggtcaaggtgatcgagcgccgcaagggctccgcgtgctcttcccccgccgactacgagtattacgtccactacaccgagttcaatagaagacttgacgagtgggttaagcttgatcagcttgatcttgacactgtcgagaccgttgtcgatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatatcgcgaagatcgaactggggagatatgagatagacacatggtatttctctccttttccaccagagtataatgactgcccgaagctgtttttctgtgaattttgcctcaacttcatgaagcgcaaagaacagcttcagaggcacatgaagaagtgtgatcttaagcaccccccaggtgatgaaatctatagaagtggaactctatcaatgttcgaggttgatgggaagaagaacaaggtttatggacagaacctttgttatctggctaagctatttcttgatcacaagacattgtactatgatgttgatttgttcttgttttatgtcctctgcgaatgtgatgatcggggatgtcatatggtgggatatttctctaaggaaaaacactccgaagaatcttataatttggcttgcattctcactctccccccataccaaagaaaaggatatgggaagttcctgattgctttctcatatgaactttccaagaaagaaggtaaagttgggacaccggagcgccctctctctgatcttggtctgctcagctatagaggttattggactagagtgcttctggaaattctaaagaaacataagggaaacatatctataaaggaactaagcgacatgacggcaataaaagcagatgacatattgagcacgctacagagcctggacctaatccagtaccgcaaagggcagcacgtcatctgcgctgacccgaaggtcctcgaccgccacctcaaggcggcggggcggggcggcctggacgtcgacgttagcaagctcatatggactccctacaaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 158 - DNA, 8701 bp, Artificial Sequence
  ZmEC1 PRO-V3::dCas9-HAT2
gtgatctaagaccagtgaagacttgggatgatgaatggagctcaggagatactatgcgctagttggtttgtatagctgaggctcgcgactgtacttatagaaggtgcaggcggacactgcaggcaagccaagagtcacaaactcacaattagtttcagaatgtgtaaagccacgtttttaatctccctctctctaatggaaaataagtgggctttactgccacagtgacactaccgcactaatgtaaagttccaccgtgccatggagccacggcacttcaacggacacaacataagtcatgcctgctcattttccaaatttgtgtgttttgattttaacccccagggtgttttgcacgtcagttcgatttttaaccttgaactttaaaactgaataccgaacgagtcctccttactggttttcaaaggtcgttttttttaaaaaaaaacttgatagctaatttacaaggcatgcaaaaacaaatagttttcctttgtgcgaggaagtttaaatactactgtataatttacgggaccgagggactacaaggcatctcagcaagtcagagtcatttcctggtatatgtaccaagttcttctacatcaagtcagtgctcattgactaattatgtgtttggtttgagatcaaaataggatgagacggggataacaccgttctctcgatttttttggatcatgctgtcataaaaaattacttcggtgttcatctcgttctcgtgtgactctcatccaaatgttatagaaaatgtggccgccctctttgatcccttcttatacgtacaaccaaacacacgttaaaagatggattgaataattgaccgtgtataactgttataacacatgttctttaggcactgataattgcacaaacagaaaagacacgatcccctccgaggcaggcccaacccccagctcacagggtcacagctgtggattagactttgtacactgctgcccatgtctccagctaaactgaaaggttcacctgtacttgagtacttctgttggctggactttctaagatatagtgaaaccaagaatgtatctatgatctatcatgaaatgacaacattaccaggttcaaaattttgaacaagagaagaagctgctgtttgactcagcccgactactttagaacacatcattacatttggactaaacctaccagttctgatagccagattgtgccattctaggaatacgtctgatggtgcaccgagactttggagtacattcaacaagaggcccaacgaaacacttttgaaggctcaatctatagcctcatcagactatatacagacaatgcaaaaccacaaaactaataacagcgacacgggcaatgttaggtgcaaagaagtggcggcagaaacgtgaattgtgagaggaaacaaacaattgtcgacagatggatcgacagtagttatcaaacctaggccattgaagtagcaactatcctcactctgatcatctgctggtagtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcagcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 159 - DNA, 7507 bp, Artificial Sequence
  ZmEC1 PRO-V3::dCAS9-jmj
gtgatctaagaccagtgaagacttgggatgatgaatggagctcaggagatactatgcgctagttggtttgtatagctgaggctcgcgactgtacttatagaaggtgcaggcggacactgcaggcaagccaagagtcacaaactcacaattagtttcagaatgtgtaaagccacgtttttaatctccctctctctaatggaaaataagtgggctttactgccacagtgacactaccgcactaatgtaaagttccaccgtgccatggagccacggcacttcaacggacacaacataagtcatgcctgctcattttccaaatttgtgtgttttgattttaacccccagggtgttttgcacgtcagttcgatttttaaccttgaactttaaaactgaataccgaacgagtcctccttactggttttcaaaggtcgttttttttaaaaaaaaacttgatagctaatttacaaggcatgcaaaaacaaatagttttcctttgtgcgaggaagtttaaatactactgtataatttacgggaccgagggactacaaggcatctcagcaagtcagagtcatttcctggtatatgtaccaagttcttctacatcaagtcagtgctcattgactaattatgtgtttggtttgagatcaaaataggatgagacggggataacaccgttctctcgatttttttggatcatgctgtcataaaaaattacttcggtgttcatctcgttctcgtgtgactctcatccaaatgttatagaaaatgtggccgccctctttgatcccttcttatacgtacaaccaaacacacgttaaaagatggattgaataattgaccgtgtataactgttataacacatgttctttaggcactgataattgcacaaacagaaaagacacgatcccctccgaggcaggcccaacccccagctcacagggtcacagctgtggattagactttgtacactgctgcccatgtctccagctaaactgaaaggttcacctgtacttgagtacttctgttggctggactttctaagatatagtgaaaccaagaatgtatctatgatctatcatgaaatgacaacattaccaggttcaaaattttgaacaagagaagaagctgctgtttgactcagcccgactactttagaacacatcattacatttggactaaacctaccagttctgatagccagattgtgccattctaggaatacgtctgatggtgcaccgagactttggagtacattcaacaagaggcccaacgaaacacttttgaaggctcaatctatagcctcatcagactatatacagacaatgcaaaaccacaaaactaataacagcgacacgggcaatgttaggtgcaaagaagtggcggcagaaacgtgaattgtgagaggaaacaaacaattgtcgacagatggatcgacagtagttatcaaacctaggccattgaagtagcaactatcctcactctgatcatctgctggtagtgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaagtggcctttcaaatactaaatgaaaagacaactgtcttgtctcctgaagtgcttctttctgctggagttccttgctgcagattggttcaaaaccctggtgaatttgttatcacattccctggagcttatcattctggttttagccatggatttaattgtggagaagcaacaaacattgcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 160 - DNA, 7377 bp, Artificial Sequence
  ZM-GLB PRO::dCas9-CBF1A
agcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacacgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaacctgcgccaaggacatccagaaagcagccgccgaagcggccctcgccttccaagacgagacgtgcgatacaaccaccacgaatcatggcctcgatatggaggaaacgatggtcgaagccatctacaccccagagcagtcagaaggcgccttctacatggacgaggaaaccatgttcggcatgccgaccctcctcgacaacatggccgaaggaatgctcctcccacctccctcagttcagtggaaccacaactacgacggcgaaggcgacggagacgtttccctgtggagctactaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 161 - DNA, 7524 bp, Artificial Sequence
  ZM-GLB PRO::dCas9-GNAT1
agcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacacgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgacttgccttgtggccgtcaattctaattctgtaaatagtagtttcaacatcgagtgtggagatgctacagatgccaactttgagaaatacaatctcagtagaggctccgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 162 - DNA, 7527 bp, Artificial Sequence
  ZM-GLB PRO::dCas9-GNAT2
agcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacacgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgaatgacggcgttgatgaacacatgatatggttggtagggttgaagaatatcttcgcccgacagcttcctaatatgcccaaagaatatattgtacgccttgtcatggatagaactcacaagtcaatgatggttatcaggaacaatattgtcgtggggggcattacttatcgcccttatgcaagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcagggtttcacaaaggagatcacattggacaaagaaagatggcaagggtacattaaagattatgacggaggaatattgatggagtgtaaaattgacgcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 163 - DNA, 8235 bp, Artificial Sequence
  ZM-GLB PRO::dCas9-HAT1
agcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacacgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatggaggtgggcacgcgcgtgatgtgccggtggcgcgaccagaagctccacccggtcaaggtgatcgagcgccgcaagggctccgcgtgctcttcccccgccgactacgagtattacgtccactacaccgagttcaatagaagacttgacgagtgggttaagcttgatcagcttgatcttgacactgtcgagaccgttgtcgatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatatcgcgaagatcgaactggggagatatgagatagacacatggtatttctctccttttccaccagagtataatgactgcccgaagctgtttttctgtgaattttgcctcaacttcatgaagcgcaaagaacagcttcagaggcacatgaagaagtgtgatcttaagcaccccccaggtgatgaaatctatagaagtggaactctatcaatgttcgaggttgatgggaagaagaacaaggtttatggacagaacctttgttatctggctaagctatttcttgatcacaagacattgtactatgatgttgatttgttcttgttttatgtcctctgcgaatgtgatgatcggggatgtcatatggtgggatatttctctaaggaaaaacactccgaagaatcttataatttggcttgcattctcactctccccccataccaaagaaaaggatatgggaagttcctgattgctttctcatatgaactttccaagaaagaaggtaaagttgggacaccggagcgccctctctctgatcttggtctgctcagctatagaggttattggactagagtgcttctggaaattctaaagaaacataagggaaacatatctataaaggaactaagcgacatgacggcaataaaagcagatgacatattgagcacgctacagagcctggacctaatccagtaccgcaaagggcagcacgtcatctgcgctgacccgaaggtcctcgaccgccacctcaaggcggcggggcggggcggcctggacgtcgacgttagcaagctcatatggactccctacaaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 164 - DNA, 8451 bp, Artificial Sequence
  ZM-GLB PRO::dCas9-HAT2
agcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacacgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaatgatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcagcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 165 - DNA, 7257 bp, Artificial Sequence
  ZM-GLB PRO::dCAS9-jmj
agcttgccgagtgccatccttggacactcgataaagtatattttattttttttattttgccaaccaaactttttgtggtatgttcctacactatgtagatctacatgtaccattttggcacaattacaaaaatgttttctataactattagatttagttcgtttatttgaatttcttcggaaaattcacatatgaactgcaagtcactcgaaacatgaaaaaccgtgcatgcaaaataaatgatatgcatgttatctagcacaagttacgaccgatttcagaagcagaccagaatcttcaagcaccatgctcactaaacatgaccgtgaacttgttatccagttgtttaaaaattgtataaaacacaaataaagtcagaaattaatgaaacttgtccacatgtcatgatatcatatatagaggttgtgataaaaatttgatattgtttcggtaaagttgtgacgtactatgtgtagaaacctaagtgacctacacataaaatcatagagtttcaatgtagttcactcgacaaagactttgtcaagtgtccgataaaaagtattcagcaaagaagccgttgtcgatttactgttcgtcgagatctctttgccgagtgtcacactaggcaaagtctttacggagtgtttttcaggctttgacactcggcaaagcgctcgattccagtagtgacagtaatttgcatcaaaaatagccgagagatttaaaatgagtcaactaatagaccaactaattattagctattagtcgttagcttctttaatctaagctaaaaccaactaatagcttatttgttgaattacaattagctcaacggaattctctgttttttctataaaaaagggaaactgcccctcatttacagcaaactgtccgctgcctgtcgtccagatacaatgaacgtacctagtaggaactcttttacacgctcggtcgctcgccgcggatcggagtcccaggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaacacacacccgagcatatcacagtgacactacacgtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaagtggcctttcaaatactaaatgaaaagacaactgtcttgtctcctgaagtgcttctttctgctggagttccttgctgcagattggttcaaaaccctggtgaatttgttatcacattccctggagcttatcattctggttttagccatggatttaattgtggagaagcaacaaacattgcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 166 - DNA, 1621 bp, Zea mays
ctacatctaatgcatagaaacaccaagatcacattgtactagcaaaatgtcatagaagactagttaaaaccttgtttggtccgctcaaccttaaaaatcacctaggagacatgctagaagtatctcaacagagaatgacaccatatagtagtggcaccaagtgcctaatctgcacacaaaaaatcgtacaatacatgacatcaaggcttaataatagagtgtatgttaaagcgagcatgcaacctatgagtggtatgtaggagttaggtttaaacaaggtaatggctcaagcaccacacatcctaccacaatgtcgtaataaatataaaagcactagcaatctatttagcatgcctaaatgggatactatgaggttgggtgggatgtggcacctttgtataatggcccagttccttagtgtagtcttgatcctccccgttaggttcagactcctctagggattttgtaggaatcatcaaattttcataagcaatttcttgtgcacaaagaaccaaatagattgaaaaagttccaaattcactcaaacacaaaaccatggcacatagcttatgtgacaaaatatttggacactagtttcatattttttgagatcatataagtttattatcaaactccaaggattaaattattttttgaaaaaaaaagaaaaagggaaaacatcataaggtgacacatggcaacctctgaatgactagacttttaccatctctcaggtgggtctggtcaacaatcactgttggtcggtccttaccttgcctagacgggtccttagtaggcctactgggttgagttatgggataaattgtggcctagaaacataccagtccaccaaccttgggaccacttaaaaaattgcatcttgcaccattatactatttagatgtttttaaaaaacaataataacttttacatcgaaatcaaaactagacaaattttatactttcacagagcagcagaaatttatacaatatgattgaatacaagatgtaggacccaatggagagaatttttttgtctcctatatgcttgaatacccaacataatatcttcgcagcatactatctatctaatagaaaaattataatatagttaaatacttaagtagtatctagtggatagaattcaatatctcatacatgcatgaggagtaatatctactagacatgcaacatatttttatctatctaatagaatatatataataaagttaaatattatatgcatcacctactatatataatttgatatcttttagatgtataagggactaagaataatatctctagcacacatgcaatgcattatctatctaaatatattatataatagttaaatattaattatacgtagtctaaacctacatataagcctacccatccccacttaaagatctcagtgtcacacatagaccatacatctcacttcgccaaaaaaatttcgtcaacagttgaagttatacccataatagttaaatattaattatacgtagtctaaacctacatataagcctacccatccccacttaaagatctcagtgtcacacatagaccatacatctcacttcgccaaaaaaatttcgtcaacagttgaagttataccc

SEQ ID NO: 167 - protein, 63 aa, Zea mays
ATGGCAAAACTACTCTTGGGTTTGCTCCTTGCCCTTGCTATTCTAGGGACAACATCGGCTGCT

SEQ ID NO: 168 - DNA, 1454 bp, Zea mays
tcaaattcaaatataattcttcaaatgttatatatggtccactcaaaagtttgccacgttattttagattaaaaaaagttgttagatatgtatgtctgtccattcgattaggggtgctaaaaatattatcaaaactaattaactaaaaaaatttcatttaaaaagtaattgaacccaaaatatcatggtatgtttggtgaagacagtgatcagtgatttttttatatctatatatatatcaaagatacttgattttctagaaggttctttttgttgttttcccttatgtttttacgcatgatgcaattctttttgagaggtttccgatgcattgatgttattgtattatctcctatatataggtcgacgtacattatgtattgcaataaccagttaactggatccagcttcgcttagtttttagtttttggcagaaaaaatgatcaatgtttcacaaaccaaatatttttataacttttgatgaaagaagatcaccacggtcatatctaggggtggtaacaaattgcgatctaaatgtttcttcataaaaaataaggcttcttaataaattttagttcaaaataaatacgaataaagtctgattctaatctgattcgatccttaaattttataatgcaaaatttagagctcattaccacctctagtcatatgtctagtctgaggtatatccaaaaagccctttctctaaattccacacccaactcagatgtttgcaaataaatactccgactccaaaatgtaggtgaagtgcaactttctccattttatatcaacatttgttattttttgtttaacatttcacactcaaaactaattaataaaatacgtggttgttgaacgtgcgcacatgtctcccttacattatgtttttttatttatgtattattgttgttttcctccgaacaacttgtcaacatatcatcattggtctttaatatttatgaatatggaagcctagttatttacacttggctacacactagttgtagttttgccacttgtctaacatgcaactctagtagttttgccacttgcctggcatgcaactctagtattgacacttgtatagcatataatgccaatacgacacctgccttacatgaaacattatttttgacacttgtataccatgcaacattaccattgacatttgtccatacacattatatcaaatatattgagcgcatgtcacaaactcgatacaaagctggatgaccctccctcaccacatctataaaaacccgagcgctactctaaatcactcacaacacaacacatatcttttagtaacctttcaataggcgtcccccaagaactagtaaacccctccctcaccacatctataaaaacccgagcgctactctaaatcactcacaacacaacacatatcttttagtaacctttcaataggcgtcccccaagaactagtaaac

SEQ ID NO: 169 - DNA, 72 bp, Zea mays
atggcaaaactgttgagcctgttcttagccctctcctttgtagcagctatgtttgccataggctctcatgct

SEQ ID NO: 170 - DNA, 1278 bp, Artificial Sequence
  SSP-BBM403(Var2)
atggcaaaactactcttgggtttgctccttgcccttgctattctagggacaacatcggctgctgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataa

SEQ ID NO: 171 - DNA, 1275 bp, Artificial Sequence
  SSP-BBM402
atggcaaaactactcttgggtttgctccttgcccttgctattctagggacaacatcggctgctgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcgga

SEQ ID NO: 172 - DNA, 1128 bp, Artificial Sequence
  SSP-DZ470(TR3)
atggcaaaactactcttgggtttgctccttgcccttgctattctagggacaacatcggctgctgcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatga

SEQ ID NO: 173 - DNA, 1125 bp, Artificial Sequence
  SSP-DZ470(TR4)
atggcaaaactactcttgggtttgctccttgcccttgctattctagggacaacatcggctgctgcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcaga

SEQ ID NO: 174 - DNA, 945 bp, Artificial Sequence
  SSP-CDKA1
atggcaaaactactcttgggtttgctccttgcccttgctattctagggacaacatcggctgctgagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtga

SEQ ID NO: 175 - DNA, 939 bp, Artificial Sequence
  SSP-CDKA3
atggcaaaactactcttgggtttgctccttgcccttgctattctagggacaacatcggctgctgaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctag

SEQ ID NO: 176 - DNA, 969 bp, Artificial Sequence
  SSP-WUS2
atggcaaaactactcttgggtttgctccttgcccttgctattctagggacaacatcggctgctgcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtga

SEQ ID NO: 177 - DNA, 966 bp, Artificial Sequence
  SSP-WUS2(TR2)
atggcaaaactactcttgggtttgctccttgcccttgctattctagggacaacatcggctgctgcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatg

SEQ ID NO: 178 - DNA, 3281 bp, Artificial Sequence
  BBM403(Var2)
ctacatctaatgcatagaaacaccaagatcacattgtactagcaaaatgtcatagaagactagttaaaaccttgtttggtccgctcaaccttaaaaatcacctaggagacatgctagaagtatctcaacagagaatgacaccatatagtagtggcaccaagtgcctaatctgcacacaaaaaatcgtacaatacatgacatcaaggcttaataatagagtgtatgttaaagcgagcatgcaacctatgagtggtatgtaggagttaggtttaaacaaggtaatggctcaagcaccacacatcctaccacaatgtcgtaataaatataaaagcactagcaatctatttagcatgcctaaatgggatactatgaggttgggtgggatgtggcacctttgtataatggcccagttccttagtgtagtcttgatcctccccgttaggttcagactcctctagggattttgtaggaatcatcaaattttcataagcaatttcttgtgcacaaagaaccaaatagattgaaaaagttccaaattcactcaaacacaaaaccatggcacatagcttatgtgacaaaatatttggacactagtttcatattttttgagatcatataagtttattatcaaactccaaggattaaattattttttgaaaaaaaaagaaaaagggaaaacatcataaggtgacacatggcaacctctgaatgactagacttttaccatctctcaggtgggtctggtcaacaatcactgttggtcggtccttaccttgcctagacgggtccttagtaggcctactgggttgagttatgggataaattgtggcctagaaacataccagtccaccaaccttgggaccacttaaaaaattgcatcttgcaccattatactatttagatgtttttaaaaaacaataataacttttacatcgaaatcaaaactagacaaattttatactttcacagagcagcagaaatttatacaatatgattgaatacaagatgtaggacccaatggagagaatttttttgtctcctatatgcttgaatacccaacataatatcttcgcagcatactatctatctaatagaaaaattataatatagttaaatacttaagtagtatctagtggatagaattcaatatctcatacatgcatgaggagtaatatctactagacatgcaacatatttttatctatctaatagaatatatataataaagttaaatattatatgcatcacctactatatataatttgatatcttttagatgtataagggactaagaataatatctctagcacacatgcaatgcattatctatctaaatatattatataatagttaaatattaattatacgtagtctaaacctacatataagcctacccatccccacttaaagatctcagtgtcacacatagaccatacatctcacttcgccaaaaaaatttcgtcaacagttgaagttatacccataatagttaaatattaattatacgtagtctaaacctacatataagcctacccatccccacttaaagatctcagtgtcacacatagaccatacatctcacttcgccaaaaaaatttcgtcaacagttgaagttataccctcccggcggatctcgactctagaggatcgctcaggaaggccgctgagatagagccatggcaaaactactcttgggtttgctccttgcccttgctattctagggacaacatcggctgctgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggataaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 179 - DNA, 4469 bp, Artificial Sequence
  SSP-BBM402 + SSP-Dz470
ctacatctaatgcatagaaacaccaagatcacattgtactagcaaaatgtcatagaagactagttaaaaccttgtttggtccgctcaaccttaaaaatcacctaggagacatgctagaagtatctcaacagagaatgacaccatatagtagtggcaccaagtgcctaatctgcacacaaaaaatcgtacaatacatgacatcaaggcttaataatagagtgtatgttaaagcgagcatgcaacctatgagtggtatgtaggagttaggtttaaacaaggtaatggctcaagcaccacacatcctaccacaatgtcgtaataaatataaaagcactagcaatctatttagcatgcctaaatgggatactatgaggttgggtgggatgtggcacctttgtataatggcccagttccttagtgtagtcttgatcctccccgttaggttcagactcctctagggattttgtaggaatcatcaaattttcataagcaatttcttgtgcacaaagaaccaaatagattgaaaaagttccaaattcactcaaacacaaaaccatggcacatagcttatgtgacaaaatatttggacactagtttcatattttttgagatcatataagtttattatcaaactccaaggattaaattattttttgaaaaaaaaagaaaaagggaaaacatcataaggtgacacatggcaacctctgaatgactagacttttaccatctctcaggtgggtctggtcaacaatcactgttggtcggtccttaccttgcctagacgggtccttagtaggcctactgggttgagttatgggataaattgtggcctagaaacataccagtccaccaaccttgggaccacttaaaaaattgcatcttgcaccattatactatttagatgtttttaaaaaacaataataacttttacatcgaaatcaaaactagacaaattttatactttcacagagcagcagaaatttatacaatatgattgaatacaagatgtaggacccaatggagagaatttttttgtctcctatatgcttgaatacccaacataatatcttcgcagcatactatctatctaatagaaaaattataatatagttaaatacttaagtagtatctagtggatagaattcaatatctcatacatgcatgaggagtaatatctactagacatgcaacatatttttatctatctaatagaatatatataataaagttaaatattatatgcatcacctactatatataatttgatatcttttagatgtataagggactaagaataatatctctagcacacatgcaatgcattatctatctaaatatattatataatagttaaatattaattatacgtagtctaaacctacatataagcctacccatccccacttaaagatctcagtgtcacacatagaccatacatctcacttcgccaaaaaaatttcgtcaacagttgaagttatacccataatagttaaatattaattatacgtagtctaaacctacatataagcctacccatccccacttaaagatctcagtgtcacacatagaccatacatctcacttcgccaaaaaaatttcgtcaacagttgaagttataccctcccggcggatctcgactctagaggatcgctcaggaaggccgctgagatagagccatggcaaaactactcttgggtttgctccttgcccttgctattctagggacaacatcggctgctgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaggctccggcgagggtcgcggttccctcctgacctgcggcgacgtggaggaaaaccccggtcccatggcaaaactactcttgggtttgctccttgcccttgctattctagggacaacatcggctgctgcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 180 - DNA, 5474 bp, Artificial Sequence
  SSP-BBM402 + SSP-Dz470 + SSP-CDKA1
ctacatctaatgcatagaaacaccaagatcacattgtactagcaaaatgtcatagaagactagttaaaaccttgtttggtccgctcaaccttaaaaatcacctaggagacatgctagaagtatctcaacagagaatgacaccatatagtagtggcaccaagtgcctaatctgcacacaaaaaatcgtacaatacatgacatcaaggcttaataatagagtgtatgttaaagcgagcatgcaacctatgagtggtatgtaggagttaggtttaaacaaggtaatggctcaagcaccacacatcctaccacaatgtcgtaataaatataaaagcactagcaatctatttagcatgcctaaatgggatactatgaggttgggtgggatgtggcacctttgtataatggcccagttccttagtgtagtcttgatcctccccgttaggttcagactcctctagggattttgtaggaatcatcaaattttcataagcaatttcttgtgcacaaagaaccaaatagattgaaaaagttccaaattcactcaaacacaaaaccatggcacatagcttatgtgacaaaatatttggacactagtttcatattttttgagatcatataagtttattatcaaactccaaggattaaattattttttgaaaaaaaaagaaaaagggaaaacatcataaggtgacacatggcaacctctgaatgactagacttttaccatctctcaggtgggtctggtcaacaatcactgttggtcggtccttaccttgcctagacgggtccttagtaggcctactgggttgagttatgggataaattgtggcctagaaacataccagtccaccaaccttgggaccacttaaaaaattgcatcttgcaccattatactatttagatgtttttaaaaaacaataataacttttacatcgaaatcaaaactagacaaattttatactttcacagagcagcagaaatttatacaatatgattgaatacaagatgtaggacccaatggagagaatttttttgtctcctatatgcttgaatacccaacataatatcttcgcagcatactatctatctaatagaaaaattataatatagttaaatacttaagtagtatctagtggatagaattcaatatctcatacatgcatgaggagtaatatctactagacatgcaacatatttttatctatctaatagaatatatataataaagttaaatattatatgcatcacctactatatataatttgatatcttttagatgtataagggactaagaataatatctctagcacacatgcaatgcattatctatctaaatatattatataatagttaaatattaattatacgtagtctaaacctacatataagcctacccatccccacttaaagatctcagtgtcacacatagaccatacatctcacttcgccaaaaaaatttcgtcaacagttgaagttatacccataatagttaaatattaattatacgtagtctaaacctacatataagcctacccatccccacttaaagatctcagtgtcacacatagaccatacatctcacttcgccaaaaaaatttcgtcaacagttgaagttataccctcccggcggatctcgactctagaggatcgctcaggaaggccgctgagatagagccatggcaaaactactcttgggtttgctccttgcccttgctattctagggacaacatcggctgctgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaggctccggcgagggtcgcggttccctcctgacctgcggcgacgtggaggaaaaccccggtcccatggcaaaactactcttgggtttgctccttgcccttgctattctagggacaacatcggctgctgcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagaggctccggcgagggtcgcggttccctcctgacctgcggcgacgtggaggaaaaccccggtcccatggcaaaactactcttgggtttgctccttgcccttgctattctagggacaacatcggctgctgagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 181 - DNA, 5468 bp, Artificial Sequence
  SSP-BBM402 + SSP-Dz470 + SSP-CDKA3
ctacatctaatgcatagaaacaccaagatcacattgtactagcaaaatgtcatagaagactagttaaaaccttgtttggtccgctcaaccttaaaaatcacctaggagacatgctagaagtatctcaacagagaatgacaccatatagtagtggcaccaagtgcctaatctgcacacaaaaaatcgtacaatacatgacatcaaggcttaataatagagtgtatgttaaagcgagcatgcaacctatgagtggtatgtaggagttaggtttaaacaaggtaatggctcaagcaccacacatcctaccacaatgtcgtaataaatataaaagcactagcaatctatttagcatgcctaaatgggatactatgaggttgggtgggatgtggcacctttgtataatggcccagttccttagtgtagtcttgatcctccccgttaggttcagactcctctagggattttgtaggaatcatcaaattttcataagcaatttcttgtgcacaaagaaccaaatagattgaaaaagttccaaattcactcaaacacaaaaccatggcacatagcttatgtgacaaaatatttggacactagtttcatattttttgagatcatataagtttattatcaaactccaaggattaaattattttttgaaaaaaaaagaaaaagggaaaacatcataaggtgacacatggcaacctctgaatgactagacttttaccatctctcaggtgggtctggtcaacaatcactgttggtcggtccttaccttgcctagacgggtccttagtaggcctactgggttgagttatgggataaattgtggcctagaaacataccagtccaccaaccttgggaccacttaaaaaattgcatcttgcaccattatactatttagatgtttttaaaaaacaataataacttttacatcgaaatcaaaactagacaaattttatactttcacagagcagcagaaatttatacaatatgattgaatacaagatgtaggacccaatggagagaatttttttgtctcctatatgcttgaatacccaacataatatcttcgcagcatactatctatctaatagaaaaattataatatagttaaatacttaagtagtatctagtggatagaattcaatatctcatacatgcatgaggagtaatatctactagacatgcaacatatttttatctatctaatagaatatatataataaagttaaatattatatgcatcacctactatatataatttgatatcttttagatgtataagggactaagaataatatctctagcacacatgcaatgcattatctatctaaatatattatataatagttaaatattaattatacgtagtctaaacctacatataagcctacccatccccacttaaagatctcagtgtcacacatagaccatacatctcacttcgccaaaaaaatttcgtcaacagttgaagttatacccataatagttaaatattaattatacgtagtctaaacctacatataagcctacccatccccacttaaagatctcagtgtcacacatagaccatacatctcacttcgccaaaaaaatttcgtcaacagttgaagttataccctcccggcggatctcgactctagaggatcgctcaggaaggccgctgagatagagccatggcaaaactactcttgggtttgctccttgcccttgctattctagggacaacatcggctgctgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaggctccggcgagggtcgcggttccctcctgacctgcggcgacgtggaggaaaaccccggtcccatggcaaaactactcttgggtttgctccttgcccttgctattctagggacaacatcggctgctgcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagaggctccggcgagggtcgcggttccctcctgacctgcggcgacgtggaggaaaaccccggtcccatggcaaaactactcttgggtttgctccttgcccttgctattctagggacaacatcggctgctgaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 182 - DNA, 2972 bp, Artificial Sequence
  SSP-WUS
ctacatctaatgcatagaaacaccaagatcacattgtactagcaaaatgtcatagaagactagttaaaaccttgtttggtccgctcaaccttaaaaatcacctaggagacatgctagaagtatctcaacagagaatgacaccatatagtagtggcaccaagtgcctaatctgcacacaaaaaatcgtacaatacatgacatcaaggcttaataatagagtgtatgttaaagcgagcatgcaacctatgagtggtatgtaggagttaggtttaaacaaggtaatggctcaagcaccacacatcctaccacaatgtcgtaataaatataaaagcactagcaatctatttagcatgcctaaatgggatactatgaggttgggtgggatgtggcacctttgtataatggcccagttccttagtgtagtcttgatcctccccgttaggttcagactcctctagggattttgtaggaatcatcaaattttcataagcaatttcttgtgcacaaagaaccaaatagattgaaaaagttccaaattcactcaaacacaaaaccatggcacatagcttatgtgacaaaatatttggacactagtttcatattttttgagatcatataagtttattatcaaactccaaggattaaattattttttgaaaaaaaaagaaaaagggaaaacatcataaggtgacacatggcaacctctgaatgactagacttttaccatctctcaggtgggtctggtcaacaatcactgttggtcggtccttaccttgcctagacgggtccttagtaggcctactgggttgagttatgggataaattgtggcctagaaacataccagtccaccaaccttgggaccacttaaaaaattgcatcttgcaccattatactatttagatgtttttaaaaaacaataataacttttacatcgaaatcaaaactagacaaattttatactttcacagagcagcagaaatttatacaatatgattgaatacaagatgtaggacccaatggagagaatttttttgtctcctatatgcttgaatacccaacataatatcttcgcagcatactatctatctaatagaaaaattataatatagttaaatacttaagtagtatctagtggatagaattcaatatctcatacatgcatgaggagtaatatctactagacatgcaacatatttttatctatctaatagaatatatataataaagttaaatattatatgcatcacctactatatataatttgatatcttttagatgtataagggactaagaataatatctctagcacacatgcaatgcattatctatctaaatatattatataatagttaaatattaattatacgtagtctaaacctacatataagcctacccatccccacttaaagatctcagtgtcacacatagaccatacatctcacttcgccaaaaaaatttcgtcaacagttgaagttatacccataatagttaaatattaattatacgtagtctaaacctacatataagcctacccatccccacttaaagatctcagtgtcacacatagaccatacatctcacttcgccaaaaaaatttcgtcaacagttgaagttataccctcccggcggatctcgactctagaggatcgctcaggaaggccgctgagatagagccatggcaaaactactcttgggtttgctccttgcccttgctattctagggacaacatcggctgctgcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 183 - DNA, 4160 bp, Artificial Sequence
  SSP-WUS + SSP-DZ470
ctacatctaatgcatagaaacaccaagatcacattgtactagcaaaatgtcatagaagactagttaaaaccttgtttggtccgctcaaccttaaaaatcacctaggagacatgctagaagtatctcaacagagaatgacaccatatagtagtggcaccaagtgcctaatctgcacacaaaaaatcgtacaatacatgacatcaaggcttaataatagagtgtatgttaaagcgagcatgcaacctatgagtggtatgtaggagttaggtttaaacaaggtaatggctcaagcaccacacatcctaccacaatgtcgtaataaatataaaagcactagcaatctatttagcatgcctaaatgggatactatgaggttgggtgggatgtggcacctttgtataatggcccagttccttagtgtagtcttgatcctccccgttaggttcagactcctctagggattttgtaggaatcatcaaattttcataagcaatttcttgtgcacaaagaaccaaatagattgaaaaagttccaaattcactcaaacacaaaaccatggcacatagcttatgtgacaaaatatttggacactagtttcatattttttgagatcatataagtttattatcaaactccaaggattaaattattttttgaaaaaaaaagaaaaagggaaaacatcataaggtgacacatggcaacctctgaatgactagacttttaccatctctcaggtgggtctggtcaacaatcactgttggtcggtccttaccttgcctagacgggtccttagtaggcctactgggttgagttatgggataaattgtggcctagaaacataccagtccaccaaccttgggaccacttaaaaaattgcatcttgcaccattatactatttagatgtttttaaaaaacaataataacttttacatcgaaatcaaaactagacaaattttatactttcacagagcagcagaaatttatacaatatgattgaatacaagatgtaggacccaatggagagaatttttttgtctcctatatgcttgaatacccaacataatatcttcgcagcatactatctatctaatagaaaaattataatatagttaaatacttaagtagtatctagtggatagaattcaatatctcatacatgcatgaggagtaatatctactagacatgcaacatatttttatctatctaatagaatatatataataaagttaaatattatatgcatcacctactatatataatttgatatcttttagatgtataagggactaagaataatatctctagcacacatgcaatgcattatctatctaaatatattatataatagttaaatattaattatacgtagtctaaacctacatataagcctacccatccccacttaaagatctcagtgtcacacatagaccatacatctcacttcgccaaaaaaatttcgtcaacagttgaagttatacccataatagttaaatattaattatacgtagtctaaacctacatataagcctacccatccccacttaaagatctcagtgtcacacatagaccatacatctcacttcgccaaaaaaatttcgtcaacagttgaagttataccctcccggcggatctcgactctagaggatcgctcaggaaggccgctgagatagagccatggcaaaactactcttgggtttgctccttgcccttgctattctagggacaacatcggctgctgcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgggctccggcgagggtcgcggttccctcctgacctgcggcgacgtggaggaaaaccccggtcccatggcaaaactactcttgggtttgctccttgcccttgctattctagggacaacatcggctgctgcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 184 - DNA, 5165 bp, Artificial Sequence
  SSP-WUS + SSP-DZ470 + SSP-CDKA1
ctacatctaatgcatagaaacaccaagatcacattgtactagcaaaatgtcatagaagactagttaaaaccttgtttggtccgctcaaccttaaaaatcacctaggagacatgctagaagtatctcaacagagaatgacaccatatagtagtggcaccaagtgcctaatctgcacacaaaaaatcgtacaatacatgacatcaaggcttaataatagagtgtatgttaaagcgagcatgcaacctatgagtggtatgtaggagttaggtttaaacaaggtaatggctcaagcaccacacatcctaccacaatgtcgtaataaatataaaagcactagcaatctatttagcatgcctaaatgggatactatgaggttgggtgggatgtggcacctttgtataatggcccagttccttagtgtagtcttgatcctccccgttaggttcagactcctctagggattttgtaggaatcatcaaattttcataagcaatttcttgtgcacaaagaaccaaatagattgaaaaagttccaaattcactcaaacacaaaaccatggcacatagcttatgtgacaaaatatttggacactagtttcatattttttgagatcatataagtttattatcaaactccaaggattaaattattttttgaaaaaaaaagaaaaagggaaaacatcataaggtgacacatggcaacctctgaatgactagacttttaccatctctcaggtgggtctggtcaacaatcactgttggtcggtccttaccttgcctagacgggtccttagtaggcctactgggttgagttatgggataaattgtggcctagaaacataccagtccaccaaccttgggaccacttaaaaaattgcatcttgcaccattatactatttagatgtttttaaaaaacaataataacttttacatcgaaatcaaaactagacaaattttatactttcacagagcagcagaaatttatacaatatgattgaatacaagatgtaggacccaatggagagaatttttttgtctcctatatgcttgaatacccaacataatatcttcgcagcatactatctatctaatagaaaaattataatatagttaaatacttaagtagtatctagtggatagaattcaatatctcatacatgcatgaggagtaatatctactagacatgcaacatatttttatctatctaatagaatatatataataaagttaaatattatatgcatcacctactatatataatttgatatcttttagatgtataagggactaagaataatatctctagcacacatgcaatgcattatctatctaaatatattatataatagttaaatattaattatacgtagtctaaacctacatataagcctacccatccccacttaaagatctcagtgtcacacatagaccatacatctcacttcgccaaaaaaatttcgtcaacagttgaagttatacccataatagttaaatattaattatacgtagtctaaacctacatataagcctacccatccccacttaaagatctcagtgtcacacatagaccatacatctcacttcgccaaaaaaatttcgtcaacagttgaagttataccctcccggcggatctcgactctagaggatcgctcaggaaggccgctgagatagagccatggcaaaactactcttgggtttgctccttgcccttgctattctagggacaacatcggctgctgcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgggctccggcgagggtcgcggttccctcctgacctgcggcgacgtggaggaaaaccccggtcccatggcaaaactactcttgggtttgctccttgcccttgctattctagggacaacatcggctgctgcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagaggctccggcgagggtcgcggttccctcctgacctgcggcgacgtggaggaaaaccccggtcccatggcaaaactactcttgggtttgctccttgcccttgctattctagggacaacatcggctgctgagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 185 - DNA, 5159 bp, Artificial Sequence
  SSP-WUS + SSP-DZ470 + SSP-CDKA3
ctacatctaatgcatagaaacaccaagatcacattgtactagcaaaatgtcatagaagactagttaaaaccttgtttggtccgctcaaccttaaaaatcacctaggagacatgctagaagtatctcaacagagaatgacaccatatagtagtggcaccaagtgcctaatctgcacacaaaaaatcgtacaatacatgacatcaaggcttaataatagagtgtatgttaaagcgagcatgcaacctatgagtggtatgtaggagttaggtttaaacaaggtaatggctcaagcaccacacatcctaccacaatgtcgtaataaatataaaagcactagcaatctatttagcatgcctaaatgggatactatgaggttgggtgggatgtggcacctttgtataatggcccagttccttagtgtagtcttgatcctccccgttaggttcagactcctctagggattttgtaggaatcatcaaattttcataagcaatttcttgtgcacaaagaaccaaatagattgaaaaagttccaaattcactcaaacacaaaaccatggcacatagcttatgtgacaaaatatttggacactagtttcatattttttgagatcatataagtttattatcaaactccaaggattaaattattttttgaaaaaaaaagaaaaagggaaaacatcataaggtgacacatggcaacctctgaatgactagacttttaccatctctcaggtgggtctggtcaacaatcactgttggtcggtccttaccttgcctagacgggtccttagtaggcctactgggttgagttatgggataaattgtggcctagaaacataccagtccaccaaccttgggaccacttaaaaaattgcatcttgcaccattatactatttagatgtttttaaaaaacaataataacttttacatcgaaatcaaaactagacaaattttatactttcacagagcagcagaaatttatacaatatgattgaatacaagatgtaggacccaatggagagaatttttttgtctcctatatgcttgaatacccaacataatatcttcgcagcatactatctatctaatagaaaaattataatatagttaaatacttaagtagtatctagtggatagaattcaatatctcatacatgcatgaggagtaatatctactagacatgcaacatatttttatctatctaatagaatatatataataaagttaaatattatatgcatcacctactatatataatttgatatcttttagatgtataagggactaagaataatatctctagcacacatgcaatgcattatctatctaaatatattatataatagttaaatattaattatacgtagtctaaacctacatataagcctacccatccccacttaaagatctcagtgtcacacatagaccatacatctcacttcgccaaaaaaatttcgtcaacagttgaagttatacccataatagttaaatattaattatacgtagtctaaacctacatataagcctacccatccccacttaaagatctcagtgtcacacatagaccatacatctcacttcgccaaaaaaatttcgtcaacagttgaagttataccctcccggcggatctcgactctagaggatcgctcaggaaggccgctgagatagagccatggcaaaactactcttgggtttgctccttgcccttgctattctagggacaacatcggctgctgcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgggctccggcgagggtcgcggttccctcctgacctgcggcgacgtggaggaaaaccccggtcccatggcaaaactactcttgggtttgctccttgcccttgctattctagggacaacatcggctgctgcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagaggctccggcgagggtcgcggttccctcctgacctgcggcgacgtggaggaaaaccccggtcccatggcaaaactactcttgggtttgctccttgcccttgctattctagggacaacatcggctgctgaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 186 - DNA, 4310 bp, Artificial Sequence
  SSP-BBM402 + SSP-WUS
ctacatctaatgcatagaaacaccaagatcacattgtactagcaaaatgtcatagaagactagttaaaaccttgtttggtccgctcaaccttaaaaatcacctaggagacatgctagaagtatctcaacagagaatgacaccatatagtagtggcaccaagtgcctaatctgcacacaaaaaatcgtacaatacatgacatcaaggcttaataatagagtgtatgttaaagcgagcatgcaacctatgagtggtatgtaggagttaggtttaaacaaggtaatggctcaagcaccacacatcctaccacaatgtcgtaataaatataaaagcactagcaatctatttagcatgcctaaatgggatactatgaggttgggtgggatgtggcacctttgtataatggcccagttccttagtgtagtcttgatcctccccgttaggttcagactcctctagggattttgtaggaatcatcaaattttcataagcaatttcttgtgcacaaagaaccaaatagattgaaaaagttccaaattcactcaaacacaaaaccatggcacatagcttatgtgacaaaatatttggacactagtttcatattttttgagatcatataagtttattatcaaactccaaggattaaattattttttgaaaaaaaaagaaaaagggaaaacatcataaggtgacacatggcaacctctgaatgactagacttttaccatctctcaggtgggtctggtcaacaatcactgttggtcggtccttaccttgcctagacgggtccttagtaggcctactgggttgagttatgggataaattgtggcctagaaacataccagtccaccaaccttgggaccacttaaaaaattgcatcttgcaccattatactatttagatgtttttaaaaaacaataataacttttacatcgaaatcaaaactagacaaattttatactttcacagagcagcagaaatttatacaatatgattgaatacaagatgtaggacccaatggagagaatttttttgtctcctatatgcttgaatacccaacataatatcttcgcagcatactatctatctaatagaaaaattataatatagttaaatacttaagtagtatctagtggatagaattcaatatctcatacatgcatgaggagtaatatctactagacatgcaacatatttttatctatctaatagaatatatataataaagttaaatattatatgcatcacctactatatataatttgatatcttttagatgtataagggactaagaataatatctctagcacacatgcaatgcattatctatctaaatatattatataatagttaaatattaattatacgtagtctaaacctacatataagcctacccatccccacttaaagatctcagtgtcacacatagaccatacatctcacttcgccaaaaaaatttcgtcaacagttgaagttatacccataatagttaaatattaattatacgtagtctaaacctacatataagcctacccatccccacttaaagatctcagtgtcacacatagaccatacatctcacttcgccaaaaaaatttcgtcaacagttgaagttataccctcccggcggatctcgactctagaggatcgctcaggaaggccgctgagatagagccatggcaaaactactcttgggtttgctccttgcccttgctattctagggacaacatcggctgctgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaggctccggcgagggtcgcggttccctcctgacctgcggcgacgtggaggaaaaccccggtcccatggcaaaactactcttgggtttgctccttgcccttgctattctagggacaacatcggctgctgcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgc

SEQ ID NO: 187 - protein, 21 aa, Zea mays
MAKLLLGLLLALAILGTTSAA

SEQ ID NO: 188 - protein, 24 aa, Zea mays
MAKLLSLFLALSFVAAMFAIGSHA

SEQ ID NO: 189 - protein, 425 aa, Artificial Sequence
  SSP-BBM403(Var2)
MAKLLLGLLLALAILGTTSAADTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGG

SEQ ID NO: 190 - protein, 425 aa, Artificial Sequence; identical to SEQ ID NO: 189
  SSP-BBM402

SEQ ID NO: 191 - protein, 375 aa, Artificial Sequence
  SSP-DZ470(TR3)
MAKLLLGLLLALAILGTTSAAAPSSYEVAASILLCAEDSSSILDLEAEAEEEALLARSGEPGGGAEFPVPSEECVAGFLESEAAHMPREDYAERLRSGGMDLRVRTDAIDWIWKVHTCYGFGPLTACLAVNYLDRFLSLYQLPEGKAWMTQLLSVACLSLAAKMEETYVPSSLDLQAGDARYVFEAKTIQRMELLVLSTLKWRMQAVTPLSYVDYFLHRLRGGAAPSRRAVLRSAELILCIARGTHCLDFRPSEIALAVAATVAGEERAVDIDRAFTHRVHKERVSRCLEAIQQATATMALPQPLKSEGPSSSGRRASSSSATVPRSPTGVLDAGCLSYRRAAAAAASHASSSWRDEDDDDCPPAVCSKRRKISR

SEQ ID NO: 192 - protein, 375 aa, Artificial Sequence; identical to SEQ ID NO: 191
  SSP-DZ470(TR4)

SEQ ID NO: 193 - protein, 314 aa, Artificial Sequence
  SSP-CDKA1
MAKLLLGLLLALAILGTTSAAEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILHGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRILGTPNEQSWPGVSCLPDFKTAFPRWQAQDLATVVPNLDPAGLDLLSKMLRYEPSKRITARQALEHEYFKDLEVVQ

SEQ ID NO: 194 - protein, 312 aa, Artificial Sequence
  SSP-CDKA3
MAKLLLGLLLALAILGTTSAADQYEKVEKIGEGTYGVVYKGKDRHTNETIALKKIRLEQEDEGVPSTAIREISLLKEMQHRNIVRLQDVVHNDKCIYLVFEYLDLDLKKHMDSSTDFKNHRIVKSFLYQILRGIAYCHSHRVLHRDLKPQNLLIDRRNNLLKLADFGLARAFGIPVRTFTHEVVTLWYRAPEILLGARHYSTPVDVWSVGCIFAEMVNQKALFPGDSEIDELFKIFRILGTPTKETWPGVASLPDYKSTFPKWPPVDLATVVPTLEPSGIDLLSKMLRLDPSKRITARAALEHDYFRDLEHA

SEQ ID NO: 195 - protein, 322 aa, Artificial Sequence
  SSP-WUS2
MAKLLLGLLLALAILGTTSAAAANAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPPSGAAPPSPTLGFYAAGNGGGSAVLLDTSSDWGSSGAAMATETCFLQDYMGVTDTGSSSQWPRFSSSDTIMAAAAARAATTRAPETLPLFPTCGDDGGSGSSSYLPFWGAASTTAGATSSVAIQQQHQLQEQYSFYSNSNSTQLAGTGNQDVSATAAAAAALELSLSSWCSPYPAAGSM

SEQ ID NO: 196 - protein, 322 aa, Artificial Sequence; identical to SEQ ID NO: 195
  SSP-WUS2(TR2)

SEQ ID NO: 197 - protein, 529 aa, Zea mays
MDHHLTPTPPPPPPPMGNSAAGASSKPPTPASTPNSRLASAPSSRHAATPPHASAAASAPAPASRTVYSDRFIPSRTGSNLALFDLAPSPSSAASSSHSHDAGPAASSGSAQPAASPYCTLLRAALFGPDTPDRVASSAAACSSSSSSFSPGPSPVGTPATGNIFRFKTEVRRNAKRALFSGDQEEDALFPGIFTTRGAGPRKVPRSPYKVLDAPALQDDFYLNLVDWSSHNVLAVGLGNCVYLWNACSSKVTKLCDLGVDDNVCSVGWAQRGTHLAVGTKQGKVQIWDATRCKRIRTMESHRMRVGALAWSSSLLSSGSRDKSILHHDIRAQEDYVSKLTGHKSEVCGLKWSYDNRQLASGGNDNGLFVWNPHSVQPVLKYTEHTAAVKAIAWSPHLHGLLASGGGTADRCIRFWNTTTNTHLSCVDTGSQVCNLAWSKNVNELVSTHGYSQNQIIVWRYPTMSKLATLTGHTYRVLYLAISPDGQTIVTGAGDETLRFWNVFPSPKSQSSDSLSCIGGTSFVRSYIR

SEQ ID NO: 198 - protein, 520 aa, Zea mays
MDHHRTPMENSASSKPPTPASTPNSRLASAPSPRHSATPPHASAPASAPAPASRTVYSDRFIPSRAGSNLALFDLGPSPSPAAAAASSSSSHEAGPAASSGSAPAAASPYCALLRAALFGPDTPDRVASSAAACSSSSSSPGLSPVGTPATGNIFRFKTEVRRNAKRALFSGGEEEEDALFPGIFTTRGAGPRKVPRSPYKVLDAPALQDDFYLNLVDWSSHNVLAVGLGNCVYLWNACSSKVTKLCDLGVDDNVCSVGWAQRGTHLAVGTNQGKVQIWDATRCKRIRTMESHRMRVGALAWSSSLLSSGSRDKSILHHDIRAQEDHVSKLTGHKSEVCGLKWSYDNRQLASGGNDNRLFVWNPHSVQPVLKYTEHTAAVKAIAWSPHLHGLLASGGGTADRCIRFWNTTTNAHLSCVDTGSQVCNLAWSKNVNELVSTHGYSQNQIIVWRYPTMSKLATLTGHTYRVLYLAISPDGQTIVTGAGDETLRFWNVFPSPKSQSSDSLSCVGGTSFVRSYIR

SEQ ID NO: 199 - protein, 231 aa, Zea mays
MESHRMRVGALAWSSSLLSSGSRDKSILHHDIRAQEDHVSKLTGHKSEVCGLKWSYDNRQLASGGNDNRLFVWNPHSVQPVLKYTEHTAAVKAIAWSPHLHGLLASGGGTADRCIRFWNTTTNAHLSCVDTGSQVCNLAWSKNVNELVSTHGYSQNQIIVWRYPTMSKLATLTGHTYRVLYLAISPDGQTIVTGAGDETLRFWNVFPSPKSQSSDSLSCVGGTSFVRSYIR

SEQ ID NO: 200 - protein, 485 aa, Zea mays
MAVAAPASDAKPRLNVPPSMASALRLDPVGLGAGPSMPSPSRRLAEPPKTPSPSKTTYSDRFIPCRSSSRLQNFALIDSPLSPAKDDTPYSRLLRAELFGPDSPKPTTATSAASASPNTNLFRFKKDHSAPTSPFAKAAAAHHDCTAGSGDAPSPQKPPRKVPKTPHKVLDAPSLQDDFYLNLVDWSSQNVLAVGLGTCVYLWSASNSKVTKLCDLGPRDSVCAVHWSREGSYLSIGTGLGDVQIWDSSRCKRIRNMGGHQTRTGVLAWSSCILSSGSRDKNILQHDIRVPNDYISKFSGHRSEVCGLEWSHDDRELASGGNDNQLLVWNQRSQQPVLRLTEHTAAVKAIAWSPHQQGLLASGGGTADRCIRFWNTANGNVLNSIDTGSQVCNLAWCKNVNELVSTHGYSQNQIMVWKYPSMSKVATLTGHTMRVLYLASSPDGQTIVTGAGDETLRFWNIFPSVRTQTPVRDIGLSSFSRSHIR

SEQ ID NO: 201 - DNA, 1105 bp, Artificial Sequence
  PHP89615 (WUS2-C5)
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgtcgtatcacccatgggcaagttttagagctagaaatagcaagttaaaataaggctagtccgttatcaacttgaaaaagtggcaccgagtcggtgcttttttttt

SEQ ID NO: 202 - DNA, 1105 bp, Artificial Sequence
  PHP89614 (WUS2-C4)
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgactcttccaaatttcgaaggttttagagctagaaatagcaagttaaaataaggctagtccgttatcaacttgaaaaagtggcaccgagtcggtgcttttttttt

SEQ ID NO: 203 - DNA, 1105 bp, Artificial Sequence
  PHP89613 (WUS2-C3)
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcaaatgacttctgtctctagttttagagctagaaatagcaagttaaaataaggctagtccgttatcaacttgaaaaagtggcaccgagtcggtgcttttttttt

SEQ ID NO: 204 - DNA, 1103 bp, Artificial Sequence
  PHP89612 (WUS2-C2)
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgttgccacaaggggagccgttttagagctagaaatagcaagttaaaataaggctagtccgttatcaacttgaaaaagtggcaccgagtcggtgcttttttttt

SEQ ID NO: 205 - DNA, 1103 bp, Artificial Sequence
  PHP89611 (WUS2-C1)
tgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgcctttgcagtttgcaccgttttagagctagaaatagcaagttaaaataaggctagtccgttatcaacttgaaaaagtggcaccgagtcggtgcttttttttt

SEQ ID NO: 206 - DNA, 7742 bp, Artificial Sequence
  RV038531
gtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggatcactatctcgacattaggctgaggccagatcctgagtttccacctgctcagcttatgagcgttttgttcggtaagctccaccaggccctggtggcacagggcggagacagaattggtgttagcttcccagatcttgacgaaagccgtagcaggttgggcgagagactccgtattcacgctagcgccgatgacctgagggcacttttggctagaccttggctcgaaggactgcgtgatcaccttcagtttggtgagccagccgtggttcctcacccaaccccttacaggcaggtgagcagagttcaggcaaagagcaatccagaacgtttgaggagaaggctcatgcgtaggcacgacctgagcgaggaagaggctagaaagcgtattcctgataccgtggccagggcacttgacttgccattcgttaccctcagaagccagagcaccggccagcacttccgtctgtttattaggcacggacctcttcaggtgaccgctgaagagggtggcttcacctgctatggattgagcaagggtggcttcgttccatggttttgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcccacagcaagcacggcctgaaggaggagatgaccatgaagtaccacatggagggctgcgtgaacggccacaagttcgtgatcaccggcgagggcatcggctaccccttcaagggcaagcagaccatcaacctgtgcgtgatcgagggcggccccctgcccttcagcgaggacatcctgagcgccggcttcaagtacggcgaccggatcttcaccgagtacccccaggacatcgtggactacttcaagaacagctgccccgccggctacacctggggccggagcttcctgttcgaggacggcgccgtgtgcatctgtaacgtggacatcaccgtgagcgtgaaggagaactgcatctaccacaagagcatcttcaacggcgtgaacttccccgccgacggccccgtgatgaagaagatgaccaccaactgggaggccagctgcgagaagatcatgcccgtgcctaagcagggcatcctgaagggcgacgtgagcatgtacctgctgctgaaggacggcggccggtaccggtgccagttcgacaccgtgtacaaggccaagagcgtgcccagcaagatgcccgagtggcacttcatccagcacaagctgctgcgggaggaccggagcgacgccaagaaccagaagtggcagctgaccgagcacgccatcgccttccccagcgccctggcctgacgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattggcgcgccgttcactgccgtataggcaggcgagccagttgttcacaggttttagagctagaaatagcaagttaaaataaggctagtccgttatcaacttgaaaaagtggcaccgagtcggtgctgttcactgccgtataggcaggaggccatgttcactccagttttagagctagaaatagcaagttaaaataaggctagtccgttatcaacttgaaaaagtggcaccgagtcggtgctgttcactgccgtataggcaggagaagtggaggttaagatgttttagagctagaaatagcaagttaaaataaggctagtccgttatcaacttgaaaaagtggcaccgagtcggtgctgttcactgccgtataggcaggtcagtcaatactctcaagttttagagctagaaatagcaagttaaaataaggctagtccgttatcaacttgaaaaagtggcaccgagtcggtgctgttcactgccgtataggcaggagcaattactcctggtagttttagagctagaaatagcaagttaaaataaggctagtccgttatcaacttgaaaaagtggcaccgagtcggtgctgttcactgccgtataggcaggtacactccagaagattaggttttagagctagaaatagcaagttaaaataaggctagtccgttatcaacttgaaaaagtggcaccgagtcggtgctgttcactgccgtataggcaggttcactgccgtataggcaggcgatcgctttttttt

SEQ ID NO: 207 - DNA, 97 bp, Artificial Sequence
  sgRNA WUS2
gtcgtatcacccatgggcaagttttagagctagaaatagcaagttaaaataaggctagtccgttatcaacttgaaaaagtggcaccgagtcggtgct

SEQ ID NO: 208 - DNA, 97 bp, Artificial Sequence
  sgRNA ODP2/BBM
actcaagccgctaccattaggttttagagctagaaatagcaagttaaaataaggctagtccgttatcaacttgaaaaagtggcaccgagtcggtgct

SEQ ID NO: 209 - DNA, 97 bp, Artificial Sequence
  sgRNA LEC1
tagcctgtgcttgctaccccgttttagagctagaaatagcaagttaaaataaggctagtccgttatcaacttgaaaaagtggcaccgagtcggtgct

SEQ ID NO: 210 - DNA, 12142 bp, Artificial Sequence
  20646
agcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcggccgccccgggcaactttattatacaaagttggcattataaaaaagcattgcttatcaatttgttgcaacgaacaggtcactatcagtcaaaataaaatcattatttggagctccatggtagcgttaacgcggccgcgatatcccctatagtgagtcgtattacatggtcatagctgtttcctggcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccctgcagctctagagctcgaattctacaggtcactaataccatctaagtagttggttcatagtgactgcatatgttgtgttttacagtattatgtagtctgttttttatgcaaaatctaatttaatatattgatatttatatcattttacgtttctcgttcaactttcttgtacaaagtggccgttaacggatcggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccacactgatagtttaaactgaaggcgggaaacgacaatctgatcatgagcggagaattaagggagtcacgttatgacccccgccgatgacgcgggacaagccgttttacgtttggaactgacagaaccgcaacgattgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattagagtctcatattcactctcccggcggatctcgactctagaggatcgctcaggaaggccgctgagatagagccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattgtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgggatccgatatcgatgggccctggccga

SEQ ID NO: 211 - DNA, 1635 bp, Candidatus Micrarchaeota archaeon
atgaacatgagtaaaactacgatttcagtaaaattaaagattattgacttaagctctgagaaaaaagagtttcttgataactattttaacgaatacgcaaaagccacgacgttctgccagttaagaatacggcgacttttgagaaatacacactggcttgggaaaaaggagaagagttcaaaaaagtggatttttgaaagtggaatatgcgatttgtgcggtgaaaacaaagaacttgtgaatgaagatagaaattcaggcgaacctgcaaaaatttgcaaaagatgttataatggaagatatggcaatcagatgatacgtaaacttttcgtttcaacgaagaaaagagaagttcaggaaaacatggacatacgaagagtcgctaaactaaataatacgcattatcaccgcataccggaagaagcatttgacatgattaaagccgccgatacagcagaaaaaagaagaaagaagaatgtcgagtatgataaaaaaagacagatggaatttattgagatgtttaatgacgaaaaaaaacgtgcggcaagaccaaaaaaaccaaacgaaagggaaacccgttacgttcatatttctaaattggaaagtccgtcaaagggatatactctgaacggaataaaaagaaaaatagacggcatgggtaaaaaaattgagagagcagaaaaaggtctctcaagaaagaagatttttggttatcagggcaatagaatcaaacttgattcgaattgggtccggtttgaccttgccgaatcggagattactatcccctcactgtttaaggaaatgaaactaaggataactggaccgaccaacgttcattcaaaaagcgggcagatatattttgcagaatggtttgagcggataaacaaacaaccgaataattactgttatctgataagaaaaacaagttcgaacggcaaatatgaatattatcttcaatatacttatgaagccgaagttgaggcgaataaggagtacgctgggtgtttgggggttgatataggatgttctaaacttgctgccgcagtttattatgattcaaaaaacaaaaaagcacaaaaaccaattgagatattcacgaatccgattaaaaaaatcaagatgcggcgcgagaaactgattaaacttctttccagagttaaggtgcggcacagacgcagaaaactcatgcaactcagtaaaactgaacccattatagactatacgtgccacaaaaccgcaagaaaaattgttgaaatggcaaatactgccaaagcttttatctcaatggagaatcttgaaactgggataaagcaaaagcaacaggcaagagaaacaaaaaagcagaagttttatcggaatatgtttcttttcagaaaattaagcaaactaatagagtacaaggctctgctgaaagggataaagatagtatatgtgaaacccgattatacaagccaaacttgttcttcatgtggcgcagacaaagaaaaaaccgagcgcccatcacaagcaatatttcgctgtcttaatccaacatgccgatattatcaaagagacataaatgccgacttcaacgccgcagtgaatatagctaagaaagctttaaataatactgaagtagtaactacgttattatga

SEQ ID NO: 212 - DNA, 1761 bp, Candidatus Micrarchaeota archaeon
atgccatccgaaacatacattacgaaaaccttgtcattaaaactcattccatcagatgaagaaaagcaggcgttagaaaactattttataacattccagagggccgtgaattttgctatagatagaatagtagatataagaagctcctttagatatctaaacaaaaatgaacaatttccagccgtgtgtgattgctgtggtaagaaagaaaagataatgtatgtgaatatatccaataaaacctttaagtttaaaccatcaagaaatcagaaggatagatacacgaaggacatttatacaatcaagcccaatgcccacatatgtaagacatgctacagtggcgttgcaggaaatatgtttatacgcaaacaaatgtatccgaacgataaagaagggtggaaagtttcgcgttcatacaatatcaaagttaatgcccctggactgactggaaccgaatatgctatggccatacggaaggcaataagtatattaagatcttttgaaaagcgacgaagaaatgctgaaagaagaatcatagagtatgaaaagtccaaaaaagagtatttagaattgattgatgatgttgaaaaaggaaagacaaataaaatagtggttcttgagaaagaaggccatcagcgagtgaaaagatataaacacaagaattggcctgagaaatggcaaggtatttctttaaataaagcaaaaagtaaggttaaagatattgagaaaagaataaaaaagctcaaggagtggaaacaccctacactaaatcgaccatatgtcgagttacacaaaaataatgttaggatagtgggttatgaaacagtggaacttaaattaggaaacaaaatgtacaccatacattttgctagcatatctaatttacgaaaaccatttagaaaacaaaagaaaaagtccatagaatatctgaaacatctcctaaccctagcgttaaaaagaaatcttgaaacataccccagcataataaaaagaggtaagaatttctttttgcagtatcctgtgcgagtgacagttaaagtgcctaagctgacaaaaaattttaaagcttttggcatcgatagaggcgtaaataggcttgcagtaggttgtataatctcaaaagatggaaaacttaccaataaaaatatttttttcttccatggaaaggaagcgtgggccaaggaaaacagatacaagaagattagggacagattatacgctatggccaagaagttgagaggagataaaaccaagaaaataaggctttatcatgagattaggaagaaatttagacataaagtcaaatatttcaggagaaactatctgcataatatctctaagcaaattgttgagattgcaaaggaaaatacaccgactgtcatcgtattagaagatttacggtacttgagagaaaggacatatagaggaaaaggaagaagcaaaaaggcgaaaaaaacaaattataaattaaatacttttacttacagaatgcttatagatatgataaaatacaaggcagaagaagcgggagttcctgtaatgattattgacccaagaaacacatcacgaaaatgttctaagtgtggttatgttgacgaaaataatagaaaacaagcctcgtttaagtgccttaagtgtggttatagtcttaatgcagacttaaatgcagctgtcaatatagcaaaagctttttatgaatgccccacgtttagatgggaagaaaaattgcatgcatatgtttgttcagagcccgataaatag

SEQ ID NO: 213 - DNA, 1812 bp, Candidatus Aureabacteria bacterium
atgaagtcatttaagctaaagttgttgccaacagatgagcaaaacgttcttttaaatgaagtgttttgtaaatgggcatcattatgtaccagaatggcgtctaaaggacacgataaagaacgactggcgcctcctgattcaagcgggaattattttaacaaaacacaactcaatcaggtgaatactgatgtaactgaccatatgggtgcgcttgaagagtcagcaagtcaaaaagaaagagcagttgagaaagtcaaaagaaggttgaagctgatttcagatatgctctctgagccaaatttaagggatgtttctcaacaaaaaccaaccacgttccgtccattagagtgggttaaggagggtctgttaaaaacaaaataccatactgtgcattattggcaaaaggaatgtgataagttaacaaaacaaaaagaacgaatggagaaaacaattgagaagataaagaaagggaagataacgttcaaaccaacaaagatgtccctgcaccaaaattgtttttcgttatcattcggaaagggaacgttttcaatgcggccttttagcgacactaaacgaggcataaatcttgatatgctaactgctcccattcaacctgcaataggaaaaaacgatggcaaatcatctttgaggagcaaagagtttatcgcaaggaatattgaaaactacattattttttccatccactcacaactatttgggctgagcaggtcagaagaactgttgttaaacgcaaaaaaagaggaactcgttgctaagcgagatgcaatgctcaaaaagaaatctgattcgctaagtaaaaaaataaaggaattagaaaaaatagtaggaagaaaaattactgattcagaacgttcagagataatgtctcagggcggcaaattgtcttctgaaaagttcagtgaagataattcatatttgaaaacgttaaaggtgctggcaaaagacattattgggcgagaggaattgttcagacttaagaagtacccgattgtgattagaaaacctctcaacgaacgaaaaaagctcaaaaatcttaaacctgacgaatgggaatattatttacagttgagttatgatgagttggaaaagaaagagtttacaccaaagacaattatgggaatcgatagaggactaaaacacattcttgctattgcgatttacgaccctgtgcaaaataaatttgtaaaaaatatgctcattccaaatccgatattaggttggaagtggaagttgcgaaagataaaaagaagtattcaacatatggaaaggagaatacgggctcagcaaaatgctcacgttcctgagaatcagttgaaaaaacggttgaaaagtattgagaacaaaattgattattactatcacaatgtgtcgcggcaaatattgaatctcgctcacgatttcaaatcagcaatagtggtagaagacttacagaatatgaaacaacacggaagaaagaaatcaaaaggactaagaggactaaactacgcattaagtaactttgactatggaaaaattatgggtcttgttaagtataaagcagaatcagagaatgtgcctcttcttaccgtgttgcctgcaggaacgagtcaaaattgcgcgtattgtctcttgtacggaaaagaacaaggaaattatgtgcggaataatgtcaacagtaaaataggcaagtgtaagcttcatggagaaatagatgcggacatcaatgcggcaaggacgattgcgatttgttatcataagaatattaatgaaccaaaaccatatggtgaacgaaagacttttaaaagaaagtaa

SEQ ID NO: 214 - DNA, 1590 bp, Uncultured bacterium
atggctaagaatactattacaaaaactctgaaactgagaatagttcgaccatataattctgctgaagtagagaagatagtagctgatgagaaaaacaatagggagaaaatcgccttagaaaaaaataaggataaggttaaagaggcctgtagcaagcatctcaaagttgccgcctattgcacgacgcaagtagaaagaaatgcatgccttttctgcaaagcaagaaaattagacgataagttctaccaaaagctgaggggacaatttcctgatgctgtattttggcaagagatttctgagatattcaggcaattgcagaagcaagctgctgaaatatataatcaaagtctcatcgaactatattacgagatttttataaagggaaaaggaattgcaaatgcttcatcagttgagcattatctcagtgatgtttgttatacaagagctgccgaattattcaaaaatgctgcgatagcaagcggtttaagatcaaagataaagagcaatttcaggctcaaggaattaaaaaatatgaaatcagggcttccgactacaaaatcagacaacttccccattcctcttgtcaagcagaaaggagggcaatataccggctttgagatttcaaatcataattctgatttcatcataaaaattccgtttggcagatggcaagtgaaaaaagagattgataaatacaggccttgggaaaagtttgattttgaacaagtgcagaagtctcctaaacccatctctctcttgctgtccacgcagagaagaaaaagaaacaaagggtggtccaaagatgagggtactgaggcagaaataaagaaagtgatgaatggagattaccaaacaagctatattgaggtaaaaagaggatcgaaaattggggagaagagtgcttggatgcttaatctttctatcgatgtccccaagatcgacaagggagttgatccgtccattataggcggaatcgatgtcggcgtgaaaagcccgcttgtgtgcgctatcaacaatgctttcagtcgttactctatctcggacaatgacctctttcatttcaacaaaaaaatgttcgccagaaggaggatattgcttaagaagaataggcataaaagagcaggacatggtgctaaaaataaacttaagcctatcaccatattaactgaaaaaagcgagagatttaggaagaaactaatcgagaggtgggcgtgcgagattgcagattttttcatcaaaaataaggttggaactgtccaaatggaaaatttggagtccatgaagagaaaagaagacagctacttcaacatcagattgagaggtttttggccttatgcagaaatgcaaaataaaatagaatttaagctcaaacagtatggtatagaaataagaaaagtagcgcctaacaatacctctaaaacgtgctccaaatgtggtcaccttaataactattttaattttgaatacagaaaaaagaacaaatttcctcatttcaagtgtgaaaagtgcaatttcaaggaaaatgcggattataacgccgctttaaatatttccaatccaaaactaaaatcaacaaaggaagaaccatag

SEQ ID NO: 215 - DNA, 1842 bp, Candidatus Micrarchaeota archaeon
atgatttcactcaaacttaaactgcttccagacgaagaacaaaagaaattgcttgacgaaatgttttggaagtgggcctcgatttgtacccgcgttggttttgggcgggctgataaagaagatttaaaaccgccaaaagacgcggaaggggtttggtttagtttaacacaattaaatcaagccaacacagacattaacgacttaagggaggcgatgaagcaccaaaaacaccgcctagaatacgaaaaaaaccgtttggaagcgcaaagagatgatactcaggatgccttgaaaaatccggacagacgagaaataagcactaaaagaaaggatttattccgtcccaaagcgtccgtcgaaaaaggctttctgaaactgaagtatcatcaagagcgttattgggttcgaaggctgaaagaaataaacaaactaattgaaaggaaaacgaagacacttataaaaatagaaaaggggcgaatcaaattcaaggcaacgcgaataaccctgcaccaaggctcttttaaaattagattcggcgataaacccgcttttctgataaaggcgttgtctggaaaaaaccaaatagacgctccttttgttgtagtgccagaacaaccaatctgcgggagcgttgtaaatagcaagaaatacttagatgaaattactactaatttcttggcttacagcgtaaatgcaatgcttttcggtttgagccgcagcgaggaaatgttgttgaaagccaaaaggccagaaaaaatcaagaaaaaagaagaaaaacttgctaaaaaacaatcagcctttgaaaacaaaaagaaggaattgcaaaaattacttggtagagaactaacccagcaggaagaagcgattattgaagaaacccgcaaccaattctttcaagattttgaggtgaaaataaccaaacaatactcggaattactcagcaaaattgctaacgaactcaagcaaaaaaatgattttctgaaagtaaacaaatatcctatacttttaaggaaacctctcaagaaagccaaatcgaaaaaaattaataatctttcgccaagcgaatggaaatattacctccaattcggagttaaacctttactaaaacaaaaatcaagacgaaaatcaaggaatgttttgggaatagaccgcggccttaaacacttgctagccgtaaccgttcttgaacccgacaaaaaaacgtttgtatggaacaaactttacccaaacccaattacgggctggaagtggaggcgacgcaagcttttgcgctccttaaagcgattgaagaggcgcattaaatcgcaaaaacacgaaacaattcatgaaaaccaaacgaggaaaaagctcaagagtttacaaggcaggatagatgacctgcttcataatatttccagaaaaatagtggagaccgcaaaagaatatgatgcggtaatagtagtggaagacctccaaagcatgcggcaacacggtcgttcaaaaggcaatcgtttgaaaacactgaattacgcgctaagccttttcgattacgcaaacgtgatgcaacttataaagtacaaggcgggtatagaaggaatccaaatatatgacgttaaaccagctggcacaagccaaaattgcgcgtattgccttttagcgcaaagggattcacacgaatacaaaagaagccaagaaaactccaaaataggtgtttgcttaaatcctaactgccaaaaccacaagaaacaaattgacgctgacctaaacgcggcaagagtaatagctagttgttacgccttaaaaattaatgattcccaaccatttggaacaaggaaaagatttaaaaaaagaacaacgaattaa

SEQ ID NO: 216 - DNA, 1503 bp, Uncultured bacterium
atggaagtacaaaaaactgtgatgaagacactttctttgagaatattaagacctctgtactcacaagaaatagaaaaagagattaaagaagaaaaagaaagaagaaaacaagccggaggaactggagagcttgacgggggattttataaaaagcttgagaagaagcattcagagatgttcagctttgataggttaaacttattgttgaatcaattacaaagagaaattgctaaggtctacaatcatgccatcagtgaattgtatatagcgactatcgctcaaggtaacaagagcaacaaacattatattagtagtattgtctataatcgagcatatggatacttttataacgcttacatagccttagggatatgttcaaaagttgaagcaaattttagatccaatgaactcctaacacaacaaagcgcattgcctacagcaaagtcagataattttccaatagttttacataaacaaaaaggtgctgagggagaggatggaggatttaggatatctactgaggggagcgatctgatatttgagatacccattccgttctatgaatataatggggagaaccgaaaagaaccctataaatgggttaaaaaaggaggacaaaaacctgtgttaaaacttatactttctacttttaggagacaaagaaataaggggtgggcaaaagacgagggcacggatgcggaaataagaaaggttacagaagggaagtatcaagtcagccaaatagaaataaataggggtaaaaaactaggagaacatcaaaaatggtttgccaatttcagcatagagcaaccaatttatgaaagaaaacctaatcggagtattgtcggcggattagacgtgggaataagatcccccctagtatgtgcaattaacaactcattttcgagatattctgttgattccaatgatgtatttaagttttctaaacaagtattcgcatttagaagacggctattatcgaaaaactctttgaaaaggaaaggtcatggggcggctcataagttagaacctatcacggaaatgacagaaaaaaatgacaagtttagaaagaaaataattgagagatgggccaaggaagttacaaatttctttgttaaaaaccaagtaggaattgttcagatagaagatttatcaacgatgaaagacagagaggatcatttttttaatcaatatcttagaggattttggccttattaccaaatgcagacattaattgagaacaagctcaaagagtatgggattgaggtaaaaagggtacaggcaaaatatacgtctcagttgtgctcaaaccctaattgcaggtattggaataactattttaactttgaataccgaaaagtaaataaattcccaaaatttaaatgtgaaaagtgtaacttagaaataagtgctgactataacgctgctcgcaatctatcaactcccgatatagagaaatttgtggcaaaagctacaaaaggcattaatttgccagaaaaatga

SEQ ID NO: 217 - DNA, 1275 bp, Parageobacillus thermoglucosidasius
atgaagtatacgaaagtaatgaggtatcaaattatcaaacccttaaacgcagaatgggatgaattgggaatggttctccgtgacatccagaaagaaactcgcgcggcattaaacaagacgattcaattgtgttgggaatatcaaggatttagtgcggattataagcagatacacggtcagtatcctaaaccaaaagatgttttaggatacacaagtatgcacggatatgcttatgatcgtctcaaaaatgaattcagcaaaattgcaagttcaaacctttcgcaaactatcaaacgagcggtagataaatggaatagtgacttaaaagaaattctgcgtggtgaccgctccatccctaacttcagaaaagattgtccaattgatatcgttaagcaatcgacgaaaatacaaaaatgtaatgatggatacgtattaagcctcggtttaattaatagagagtataaaaatgaattgggacggaaaaacggagtatttgatgtacttataaaagcaaacgataaaacccagcaaaccatattagaacgaattataaatggcgattatacatatacggcatctcaaataatcaatcataaaaataagtggtttattaaccttacctatcaatttgaaactaaagaaacagccttagatcccaataatgtcatgggagttgatctaggaattgtttatcctgtttatatagcatttaataacagtcttcaccgttatcatattaaaggaggagaaatagaacgattcagacggcaagtagaaaaaaggaagagggaattgttaaatcaaggcaaatattgtggagacgggcgtaaagggcatggttatgctacaagaacaaagtccattgaatcaattagcgataaaattgcgagatttcgtgacacttgcaatcataaatattccaggtttattgtagatatggcgcttaaacataattgtgggataattcaaatggaagatttgactggaattagcaaggaaagtacatttttgaaaaattggacatattacgatcttcagcagaaaatcgaatataaggcacgagaagcaggaatacaagttataaaaattgaaccccaatatacatctcaacgttgtagtaaatgtggctatattgataaagagaatcggcaagaacaagctacatttaagtgcatcgaatgtggttttaagacaaatgctgactataatgcagcaaggaatatcgcaataccgaacattgacaagataataaggaaaacgttaaaaatgcaataa

SEQ ID NO: 218 - DNA, 1269 bp, Acidibacillus sulfuroxidans
atgatcaaagtatatcggtatgagatcgtaaaaccgcttgatttagattggaaagagtttggaactattttacgacagttacaacaggaaactcgttttgccttaaacaaagcgactcaactggcttgggaatggatgggctttagtagtgattataaggataatcatggggaatatccaaaaagtaaagacattctcggatacacgaatgttcacggatacgcttaccatacgatcaaaaccaaagcatatcgcttaaacagtggtaatttatctcaaaccatcaaacgtgcgacggatcgttttaaagcatatcaaaaggaaatcttacgtggcgatatgtccattccgtcctataaacgagatattccactcgatctgattaaagagaatatcagcgtaaatcgtatgaatcacggggattatatcgcttcgttatctctgttaagcaatccagccaagcaagaaatgaatgtaaagaggaaaatttcggtcataatcattgtccgtggcgcagggaaaacaatcatggacagaatcctaagtggtgaataccaagtctctgcttcacaaataattcacgatgatcgaaaaaacaaatggtatttaaacataagttatgattttgaaccccaaacccgagtgttggatctaaataaaataatggggattgatttaggcgttgctgttgccgtttacatggcatttcaacatacccctgctcgatacaaattggagggaggtgagattgaaaattttcgtagacaggtagaatctcgacggattagtatgttacgtcaaggtaaatatgccggtggtgcccgtggagggcatgggcgagataaaagaataaaaccgattgaacagcttcgagataaaattgctaattttagagataccacaaaccatcgttatagtagatatatagtggatatggcaattaaagaaggttgtggaacgattcagatggaggatttaacgaatatacgcgatattggatctcgatttttacaaaattggacctattatgatttgcagcaaaaaattatttataaagccgaagaggcaggaattaaagtcataaagatcgatccccaatataccagtcaacgttgtagtgaatgtggtaatatagattccgggaatcgaattggacaagctatctttaaatgcagagcttgcggatacgaagccaatgcagactacaatgctgcacgaaacatagcaataccgaacattgacaaaattatagctgagagtatcaaataa

SEQ ID NO: 219 - protein, 544 aa, Candidatus Micrarchaeota archaeon
MNMSKTTISVKLKIIDLSSEKKEFLDNYFNEYAKATTFCQLRIRRLLRNTHWLGKKEKSSKKWIFESGICDLCGENKELVNEDRNSGEPAKICKRCYNGRYGNQMIRKLFVSTKKREVQENMDIRRVAKLNNTHYHRIPEEAFDMIKAADTAEKRRKKNVEYDKKRQMEFIEMFNDEKKRAARPKKPNERETRYVHISKLESPSKGYTLNGIKRKIDGMGKKIERAEKGLSRKKIFGYQGNRIKLDSNWVRFDLAESEITIPSLFKEMKLRITGPTNVHSKSGQIYFAEWFERINKQPNNYCYLIRKTSSNGKYEYYLQYTYEAEVEANKEYAGCLGVDIGCSKLAAAVYYDSKNKKAQKPIEIFTNPIKKIKMRREKLIKLLSRVKVRHRRRKLMQLSKTEPIIDYTCHKTARKIVEMANTAKAFISMENLETGIKQKQQARETKKQKFYRNMFLFRKLSKLIEYKALLKGIKIVYVKPDYTSQTCSSCGADKEKTERPSQAIFRCLNPTCRYYQRDINADFNAAVNIAKKALNNTEVVTTLL

SEQ ID NO: 220 - protein, 586 aa, Candidatus Micrarchaeota archaeon
MPSETYITKTLSLKLIPSDEEKQALENYFITFQRAVNFAIDRIVDIRSSFRYLNKNEQFPAVCDCCGKKEKIMYVNISNKTFKFKPSRNQKDRYTKDIYTIKPNAHICKTCYSGVAGNMFIRKQMYPNDKEGWKVSRSYNIKVNAPGLTGTEYAMAIRKAISILRSFEKRRRNAERRIIEYEKSKKEYLELIDDVEKGKTNKIVVLEKEGHQRVKRYKHKNWPEKWQGISLNKAKSKVKDIEKRIKKLKEWKHPTLNRPYVELHKNNVRIVGYETVELKLGNKMYTIHFASISNLRKPFRKQKKKSIEYLKHLLTLALKRNLETYPSIIKRGKNFFLQYPVRVTVKVPKLTKNFKAFGIDRGVNRLAVGCIISKDGKLTNKNIFFFHGKEAWAKENRYKKIRDRLYAMAKKLRGDKTKKIRLYHEIRKKFRHKVKYFRRNYLHNISKQIVEIAKENTPTVIVLEDLRYLRERTYRGKGRSKKAKKTNYKLNTFTYRMLIDMIKYKAEEAGVPVMIIDPRNTSRKCSKCGYVDENNRKQASFKCLKCGYSLNADLNAAVNIAKAFYECPTFRWEEKLHAYVCSEPDK

SEQ ID NO: 221 - protein, 603 aa, Candidatus Aureabacteria bacterium
MKSFKLKLLPTDEQNVLLNEVFCKWASLCTRMASKGHDKERLAPPDSSGNYFNKTQLNQVNTDVTDHMGALEESASQKERAVEKVKRRLKLISDMLSEPNLRDVSQQKPTTFRPLEWVKEGLLKTKYHTVHYWQKECDKLTKQKERMEKTIEKIKKGKITFKPTKMSLHQNCFSLSFGKGTFSMRPFSDTKRGINLDMLTAPIQPAIGKNDGKSSLRSKEFIARNIENYIIFSIHSQLFGLSRSEELLLNAKKEELVAKRDAMLKKKSDSLSKKIKELEKIVGRKITDSERSEIMSQGGKLSSEKFSEDNSYLKTLKVLAKDIIGREELFRLKKYPIVIRKPLNERKKLKNLKPDEWEYYLQLSYDELEKKEFTPKTIMGIDRGLKHILAIAIYDPVQNKFVKNMLIPNPILGWKWKLRKIKRSIQHMERRIRAQQNAHVPENQLKKRLKSIENKIDYYYHNVSRQILNLAHDFKSAIVVEDLQNMKQHGRKKSKGLRGLNYALSNFDYGKIMGLVKYKAESENVPLLTVLPAGTSQNCAYCLLYGKEQGNYVRNNVNSKIGKCKLHGEIDADINAARTIAICYHKNINEPKPYGERKTFKRK

SEQ ID NO: 222 - protein, 529 aa, Uncultured bacterium
MAKNTITKTLKLRIVRPYNSAEVEKIVADEKNNREKIALEKNKDKVKEACSKHLKVAAYCTTQVERNACLFCKARKLDDKFYQKLRGQFPDAVFWQEISEIFRQLQKQAAEIYNQSLIELYYEIFIKGKGIANASSVEHYLSDVCYTRAAELFKNAAIASGLRSKIKSNFRLKELKNMKSGLPTTKSDNFPIPLVKQKGGQYTGFEISNHNSDFIIKIPFGRWQVKKEIDKYRPWEKFDFEQVQKSPKPISLLLSTQRRKRNKGWSKDEGTEAEIKKVMNGDYQTSYIEVKRGSKIGEKSAWMLNLSIDVPKIDKGVDPSIIGGIDVGVKSPLVCAINNAFSRYSISDNDLFHFNKKMFARRRILLKKNRHKRAGHGAKNKLKPITILTEKSERFRKKLIERWACEIADFFIKNKVGTVQMENLESMKRKEDSYFNIRLRGFWPYAEMQNKIEFKLKQYGIEIRKVAPNNTSKTCSKCGHLNNYFNFEYRKKNKFPHFKCEKCNFKENADYNAALNISNPKLKSTKEEP

SEQ ID NO: 223 - protein, 613 aa, Candidatus Micrarchaeota archaeon
MISLKLKLLPDEEQKKLLDEMFWKWASICTRVGFGRADKEDLKPPKDAEGVWFSLTQLNQANTDINDLREAMKHQKHRLEYEKNRLEAQRDDTQDALKNPDRREISTKRKDLFRPKASVEKGFLKLKYHQERYWVRRLKEINKLIERKTKTLIKIEKGRIKFKATRITLHQGSFKIRFGDKPAFLIKALSGKNQIDAPFVVVPEQPICGSVVNSKKYLDEITTNFLAYSVNAMLFGLSRSEEMLLKAKRPEKIKKKEEKLAKKQSAFENKKKELQKLLGRELTQQEEAIIEETRNQFFQDFEVKITKQYSELLSKIANELKQKNDFLKVNKYPILLRKPLKKAKSKKINNLSPSEWKYYLQFGVKPLLKQKSRRKSRNVLGIDRGLKHLLAVTVLEPDKKTFVWNKLYPNPITGWKWRRRKLLRSLKRLKRRIKSQKHETIHENQTRKKLKSLQGRIDDLLHNISRKIVETAKEYDAVIVVEDLQSMRQHGRSKGNRLKTLNYALSLFDYANVMQLIKYKAGIEGIQIYDVKPAGTSQNCAYCLLAQRDSHEYKRSQENSKIGVCLNPNCQNHKKQIDADLNAARVIASCYALKINDSQPFGTRKRFKKRTTN

SEQ ID NO: 224 - protein, 500 aa, Uncultured bacterium
MEVQKTVMKTLSLRILRPLYSQEIEKEIKEEKERRKQAGGTGELDGGFYKKLEKKHSEMFSFDRLNLLLNQLQREIAKVYNHAISELYIATIAQGNKSNKHYISSIVYNRAYGYFYNAYIALGICSKVEANFRSNELLTQQSALPTAKSDNFPIVLHKQKGAEGEDGGFRISTEGSDLIFEIPIPFYEYNGENRKEPYKWVKKGGQKPVLKLILSTFRRQRNKGWAKDEGTDAEIRKVTEGKYQVSQIEINRGKKLGEHQKWFANFSIEQPIYERKPNRSIVGGLDVGIRSPLVCAINNSFSRYSVDSNDVFKFSKQVFAFRRRLLSKNSLKRKGHGAAHKLEPITEMTEKNDKFRKKIIERWAKEVTNFFVKNQVGIVQIEDLSTMKDREDHFFNQYLRGFWPYYQMQTLIENKLKEYGIEVKRVQAKYTSQLCSNPNCRYWNNYFNFEYRKVNKFPKFKCEKCNLEISADYNAARNLSTPDIEKFVAKATKGINLPEK

SEQ ID NO: 225 - protein, 424 aa, Parageobacillus thermoglucosidasius
MKYTKVMRYQIIKPLNAEWDELGMVLRDIQKETRAALNKTIQLCWEYQGFSADYKQIHGQYPKPKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVDLGIVYPVYIAFNNSLHRYHIKGGEIERFRRQVEKRKRELLNQGKYCGDGRKGHGYATRTKSIESISDKIARFRDTCNHKYSRFIVDMALKHNCGIIQMEDLTGISKESTFLKNWTYYDLQQKIEYKAREAGIQVIKIEPQYTSQRCSKCGYIDKENRQEQATFKCIECGFKTNADYNAARNIAIPNIDKIIRKTLKMQ

SEQ ID NO: 226 - protein, 422 aa, Acidibacillus sulfuroxidans
MIKVYRYEIVKPLDLDWKEFGTILRQLQQETRFALNKATQLAWEWMGFSSDYKDNHGEYPKSKDILGYTNVHGYAYHTIKTKAYRLNSGNLSQTIKRATDRFKAYQKEILRGDMSIPSYKRDIPLDLIKENISVNRMNHGDYIASLSLLSNPAKQEMNVKRKISVIIIVRGAGKTIMDRILSGEYQVSASQIIHDDRKNKWYLNISYDFEPQTRVLDLNKIMGIDLGVAVAVYMAFQHTPARYKLEGGEIENFRRQVESRRISMLRQGKYAGGARGGHGRDKRIKPIEQLRDKIANFRDTTNHRYSRYIVDMAIKEGCGTIQMEDLTNIRDIGSRFLQNWTYYDLQQKIIYKAEEAGIKVIKIDPQYTSQRCSECGNIDSGNRIGQAIFKCRACGYEANADYNAARNIAIPNIDKIIAESIK

SEQ ID NO: 227 - DNA, 1272 bp, Artificial Sequence
  Maize optimized dCas-alpha7
atgaaatacacaaaagtcatgcgctatcagatcattaagcccttgaatgccgagtgggacgagcttggtatggtcttgcgggatattcaaaaagaaactagggctgcgctgaacaaaactatccaactctgctgggaataccagggcttcagcgcagactacaagcaaatccacgggcaatatccgaaacctaaagacgttctgggatatacttccatgcatggctatgcctacgaccggcttaagaatgagttttcgaaaattgcatccagcaacttgtcccaaaccataaagcgggccgtggacaagtggaacagcgatctcaaggaaattttgagaggagaccggtccattccaaattttcgcaaggattgcccaattgacatcgttaaacaatcgaccaaaattcaaaaatgtaacgacggctatgtgttgtctctcggactgatcaacagggagtataagaatgaacttggaagaaaaaacggggtgtttgatgttttgatcaaagctaacgataagactcaacaaaccatattggagcgcatcataaatggtgattacacttatactgcgtcacaaattataaatcacaagaacaagtggtttattaatcttacttatcaatttgaaactaaagagacagcgctggacccaaacaatgttatgggggttgcgttgggtatagtttatccagtttatattgcttttaataacagcttgcatcgctatcacatcaaaggtggcgaaattgagaggttcaggcggcaggtggaaaagagaaagagggagttgctcaatcaaggtaagtattgtggcgacgggaggaaaggccacggttatgccacgcggacgaaaagcatagaatcaatctctgataagattgctcggttcagggatacgtgtaatcataagtattcgaggtttatagtggacatggccctcaaacataattgtggaatcatacagatgaacgacttgaccggtatttcaaaggagtcaacgttcctgaagaactggacatactacgatcttcaacagaaaattgaatataaagctagggaggcgggtatccaagttatcaaaattgagccgcaatacacctcacagcgctgctccaagtgcggctatatcgacaaggaaaaccggcaagaacaagctacattcaagtgcatcgaatgcgggttcaaaaccaatgctgcttacaatgccgctcggaatatcgccattccaaatatagataagataatcagaaagacgctgaagatgcaa

SEQ ID NO: 228 - protein, 424 aa, Artificial Sequence
  Maize optimized dCas-alpha7
MKYTKVMRYQIIKPLNAEWDELGMVLRDIQKETRAALNKTIQLCWEYQGFSADYKQIHGQYPKPKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVALGIVYPVYIAFNNSLHRYHIKGGEIERFRRQVEKRKRELLNQGKYCGDGRKGHGYATRTKSIESISDKIARFRDTCNHKYSRFIVDMALKHNCGIIQMNDLTGISKESTFLKNWTYYDLQQKIEYKAREAGIQVIKIEPQYTSQRCSKCGYIDKENRQEQATFKCIECGFKTNAAYNAARNIAIPNIDKIIRKTLKMQ

SEQ ID NO: 229 - DNA, 1719 bp, Artificial Sequence
  dCas?7-GNAT1
atgaaatacacaaaagtcatgcgctatcagatcattaagcccttgaatgccgagtgggacgagcttggtatggtcttgcgggatattcaaaaagaaactagggctgcgctgaacaaaactatccaactctgctgggaataccagggcttcagcgcagactacaagcaaatccacgggcaatatccgaaacctaaagacgttctgggatatacttccatgcatggctatgcctacgaccggcttaagaatgagttttcgaaaattgcatccagcaacttgtcccaaaccataaagcgggccgtggacaagtggaacagcgatctcaaggaaattttgagaggagaccggtccattccaaattttcgcaaggattgcccaattgacatcgttaaacaatcgaccaaaattcaaaaatgtaacgacggctatgtgttgtctctcggactgatcaacagggagtataagaatgaacttggaagaaaaaacggggtgtttgatgttttgatcaaagctaacgataagactcaacaaaccatattggagcgcatcataaatggtgattacacttatactgcgtcacaaattataaatcacaagaacaagtggtttattaatcttacttatcaatttgaaactaaagagacagcgctggacccaaacaatgttatgggggttgcgttgggtatagtttatccagtttatattgcttttaataacagcttgcatcgctatcacatcaaaggtggcgaaattgagaggttcaggcggcaggtggaaaagagaaagagggagttgctcaatcaaggtaagtattgtggcgacgggaggaaaggccacggttatgccacgcggacgaaaagcatagaatcaatctctgataagattgctcggttcagggatacgtgtaatcataagtattcgaggtttatagtggacatggccctcaaacataattgtggaatcatacagatgaacgacttgaccggtatttcaaaggagtcaacgttcctgaagaactggacatactacgatcttcaacagaaaattgaatataaagctagggaggcgggtatccaagttatcaaaattgagccgcaatacacctcacagcgctgctccaagtgcggctatatcgacaaggaaaaccggcaagaacaagctacattcaagtgcatcgaatgcgggttcaaaaccaatgctgcttacaatgccgctcggaatatcgccattccaaatatagataagataatcagaaagacgctgaagatgcaaatgacttgccttgtggccgtcaattctaattctgtaaatagtagtttcaacatcgagtgtggagatgctacagatgccaactttgagaaatacaatctcagtagaggctccgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaagtag

SEQ ID NO: 230 - DNA, 1722 bp, Artificial Sequence
  dCas?7-GNAT2
atgaaatacacaaaagtcatgcgctatcagatcattaagcccttgaatgccgagtgggacgagcttggtatggtcttgcgggatattcaaaaagaaactagggctgcgctgaacaaaactatccaactctgctgggaataccagggcttcagcgcagactacaagcaaatccacgggcaatatccgaaacctaaagacgttctgggatatacttccatgcatggctatgcctacgaccggcttaagaatgagttttcgaaaattgcatccagcaacttgtcccaaaccataaagcgggccgtggacaagtggaacagcgatctcaaggaaattttgagaggagaccggtccattccaaattttcgcaaggattgcccaattgacatcgttaaacaatcgaccaaaattcaaaaatgtaacgacggctatgtgttgtctctcggactgatcaacagggagtataagaatgaacttggaagaaaaaacggggtgtttgatgttttgatcaaagctaacgataagactcaacaaaccatattggagcgcatcataaatggtgattacacttatactgcgtcacaaattataaatcacaagaacaagtggtttattaatcttacttatcaatttgaaactaaagagacagcgctggacccaaacaatgttatgggggttgcgttgggtatagtttatccagtttatattgcttttaataacagcttgcatcgctatcacatcaaaggtggcgaaattgagaggttcaggcggcaggtggaaaagagaaagagggagttgctcaatcaaggtaagtattgtggcgacgggaggaaaggccacggttatgccacgcggacgaaaagcatagaatcaatctctgataagattgctcggttcagggatacgtgtaatcataagtattcgaggtttatagtggacatggccctcaaacataattgtggaatcatacagatgaacgacttgaccggtatttcaaaggagtcaacgttcctgaagaactggacatactacgatcttcaacagaaaattgaatataaagctagggaggcgggtatccaagttatcaaaattgagccgcaatacacctcacagcgctgctccaagtgcggctatatcgacaaggaaaaccggcaagaacaagctacattcaagtgcatcgaatgcgggttcaaaaccaatgctgcttacaatgccgctcggaatatcgccattccaaatatagataagataatcagaaagacgctgaagatgcaaatgaatgacggcgttgatgaacacatgatatggttggtagggttgaagaatatcttcgcccgacagcttcctaatatgcccaaagaatatattgtacgccttgtcatggatagaactcacaagtcaatgatggttatcaggaacaatattgtcgtggggggcattacttatcgcccttatgcaagccagagatttggagaaatagcgttttgtgctatcacagctgatgagcaagttaaaggctatggaacaagattaatgaatcatttgaaacaacatgcacgggatgctgatgggctcacacatttcttaacctatgctgataacaatgctgttggctattttgtaaagcagggtttcacaaaggagatcacattggacaaagaaagatggcaagggtacattaaagattatgacggaggaatattgatggagtgtaaaattgactag

SEQ ID NO: 231 - DNA, 2430 bp, Artificial Sequence
  dCas?7-HAT1
atgaaatacacaaaagtcatgcgctatcagatcattaagcccttgaatgccgagtgggacgagcttggtatggtcttgcgggatattcaaaaagaaactagggctgcgctgaacaaaactatccaactctgctgggaataccagggcttcagcgcagactacaagcaaatccacgggcaatatccgaaacctaaagacgttctgggatatacttccatgcatggctatgcctacgaccggcttaagaatgagttttcgaaaattgcatccagcaacttgtcccaaaccataaagcgggccgtggacaagtggaacagcgatctcaaggaaattttgagaggagaccggtccattccaaattttcgcaaggattgcccaattgacatcgttaaacaatcgaccaaaattcaaaaatgtaacgacggctatgtgttgtctctcggactgatcaacagggagtataagaatgaacttggaagaaaaaacggggtgtttgatgttttgatcaaagctaacgataagactcaacaaaccatattggagcgcatcataaatggtgattacacttatactgcgtcacaaattataaatcacaagaacaagtggtttattaatcttacttatcaatttgaaactaaagagacagcgctggacccaaacaatgttatgggggttgcgttgggtatagtttatccagtttatattgcttttaataacagcttgcatcgctatcacatcaaaggtggcgaaattgagaggttcaggcggcaggtggaaaagagaaagagggagttgctcaatcaaggtaagtattgtggcgacgggaggaaaggccacggttatgccacgcggacgaaaagcatagaatcaatctctgataagattgctcggttcagggatacgtgtaatcataagtattcgaggtttatagtggacatggccctcaaacataattgtggaatcatacagatgaacgacttgaccggtatttcaaaggagtcaacgttcctgaagaactggacatactacgatcttcaacagaaaattgaatataaagctagggaggcgggtatccaagttatcaaaattgagccgcaatacacctcacagcgctgctccaagtgcggctatatcgacaaggaaaaccggcaagaacaagctacattcaagtgcatcgaatgcgggttcaaaaccaatgctgcttacaatgccgctcggaatatcgccattccaaatatagataagataatcagaaagacgctgaagatgcaaatggaggtgggcacgcgcgtgatgtgccggtggcgcgaccagaagctccacccggtcaaggtgatcgagcgccgcaagggctccgcgtgctcttcccccgccgactacgagtattacgtccactacaccgagttcaatagaagacttgacgagtgggttaagcttgatcagcttgatcttgacactgtcgagaccgttgtcgatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatatcgcgaagatcgaactggggagatatgagatagacacatggtatttctctccttttccaccagagtataatgactgcccgaagctgtttttctgtgaattttgcctcaacttcatgaagcgcaaagaacagcttcagaggcacatgaagaagtgtgatcttaagcaccccccaggtgatgaaatctatagaagtggaactctatcaatgttcgaggttgatgggaagaagaacaaggtttatggacagaacctttgttatctggctaagctatttcttgatcacaagacattgtactatgatgttgatttgttcttgttttatgtcctctgcgaatgtgatgatcggggatgtcatatggtgggatatttctctaaggaaaaacactccgaagaatcttataatttggcttgcattctcactctccccccataccaaagaaaaggatatgggaagttcctgattgctttctcatatgaactttccaagaaagaaggtaaagttgggacaccggagcgccctctctctgatcttggtctgctcagctatagaggttattggactagagtgcttctggaaattctaaagaaacataagggaaacatatctataaaggaactaagcgacatgacggcaataaaagcagatgacatattgagcacgctacagagcctggacctaatccagtaccgcaaagggcagcacgtcatctgcgctgacccgaaggtcctcgaccgccacctcaaggcggcggggcggggcggcctggacgtcgacgttagcaagctcatatggactccctacaagtag

SEQ ID NO: 232 - DNA, 2646 bp, Artificial Sequence
  dCas?7-HAT2
atgaaatacacaaaagtcatgcgctatcagatcattaagcccttgaatgccgagtgggacgagcttggtatggtcttgcgggatattcaaaaagaaactagggctgcgctgaacaaaactatccaactctgctgggaataccagggcttcagcgcagactacaagcaaatccacgggcaatatccgaaacctaaagacgttctgggatatacttccatgcatggctatgcctacgaccggcttaagaatgagttttcgaaaattgcatccagcaacttgtcccaaaccataaagcgggccgtggacaagtggaacagcgatctcaaggaaattttgagaggagaccggtccattccaaattttcgcaaggattgcccaattgacatcgttaaacaatcgaccaaaattcaaaaatgtaacgacggctatgtgttgtctctcggactgatcaacagggagtataagaatgaacttggaagaaaaaacggggtgtttgatgttttgatcaaagctaacgataagactcaacaaaccatattggagcgcatcataaatggtgattacacttatactgcgtcacaaattataaatcacaagaacaagtggtttattaatcttacttatcaatttgaaactaaagagacagcgctggacccaaacaatgttatgggggttgcgttgggtatagtttatccagtttatattgcttttaataacagcttgcatcgctatcacatcaaaggtggcgaaattgagaggttcaggcggcaggtggaaaagagaaagagggagttgctcaatcaaggtaagtattgtggcgacgggaggaaaggccacggttatgccacgcggacgaaaagcatagaatcaatctctgataagattgctcggttcagggatacgtgtaatcataagtattcgaggtttatagtggacatggccctcaaacataattgtggaatcatacagatgaacgacttgaccggtatttcaaaggagtcaacgttcctgaagaactggacatactacgatcttcaacagaaaattgaatataaagctagggaggcgggtatccaagttatcaaaattgagccgcaatacacctcacagcgctgctccaagtgcggctatatcgacaaggaaaaccggcaagaacaagctacattcaagtgcatcgaatgcgggttcaaaaccaatgctgcttacaatgccgctcggaatatcgccattccaaatatagataagataatcagaaagacgctgaagatgcaaatgatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcatag

SEQ ID NO: 233 - DNA, 1626 bp, Artificial Sequence
  dCas?7-jmj
atgaaatacacaaaagtcatgcgctatcagatcattaagcccttgaatgccgagtgggacgagcttggtatggtcttgcgggatattcaaaaagaaactagggctgcgctgaacaaaactatccaactctgctgggaataccagggcttcagcgcagactacaagcaaatccacgggcaatatccgaaacctaaagacgttctgggatatacttccatgcatggctatgcctacgaccggcttaagaatgagttttcgaaaattgcatccagcaacttgtcccaaaccataaagcgggccgtggacaagtggaacagcgatctcaaggaaattttgagaggagaccggtccattccaaattttcgcaaggattgcccaattgacatcgttaaacaatcgaccaaaattcaaaaatgtaacgacggctatgtgttgtctctcggactgatcaacagggagtataagaatgaacttggaagaaaaaacggggtgtttgatgttttgatcaaagctaacgataagactcaacaaaccatattggagcgcatcataaatggtgattacacttatactgcgtcacaaattataaatcacaagaacaagtggtttattaatcttacttatcaatttgaaactaaagagacagcgctggacccaaacaatgttatgggggttgcgttgggtatagtttatccagtttatattgcttttaataacagcttgcatcgctatcacatcaaaggtggcgaaattgagaggttcaggcggcaggtggaaaagagaaagagggagttgctcaatcaaggtaagtattgtggcgacgggaggaaaggccacggttatgccacgcggacgaaaagcatagaatcaatctctgataagattgctcggttcagggatacgtgtaatcataagtattcgaggtttatagtggacatggccctcaaacataattgtggaatcatacagatgaacgacttgaccggtatttcaaaggagtcaacgttcctgaagaactggacatactacgatcttcaacagaaaattgaatataaagctagggaggcgggtatccaagttatcaaaattgagccgcaatacacctcacagcgctgctccaagtgcggctatatcgacaaggaaaaccggcaagaacaagctacattcaagtgcatcgaatgcgggttcaaaaccaatgctgcttacaatgccgctcggaatatcgccattccaaatatagataagataatcagaaagacgctgaagatgcaatggctgtatgtcggaatgtgcttttcatcattctgctggcatgttgaagaccatcatttgtactcactgaactacatgcattggggtgctccaaagatgtggtatggagttccaggaaaggatgctgtaaatttggaggcagcaatgaggaaacacctacctgacttgtttgaggaacaacctgatttgcttcacaacctggttactcaattttcaacatcattgcttaaatctgaaggagtaccagtctaccgatgtgttcagcatgagggagagtttgtcctaacgttccctcgggcataccatgctggtttcaactgtggcttcaattgtgcagaagctgttaatgtgtag

SEQ ID NO: 234 - DNA, 1569 bp, Artificial Sequence
  dCas?7-CBF1a
atgaaatacacaaaagtcatgcgctatcagatcattaagcccttgaatgccgagtgggacgagcttggtatggtcttgcgggatattcaaaaagaaactagggctgcgctgaacaaaactatccaactctgctgggaataccagggcttcagcgcagactacaagcaaatccacgggcaatatccgaaacctaaagacgttctgggatatacttccatgcatggctatgcctacgaccggcttaagaatgagttttcgaaaattgcatccagcaacttgtcccaaaccataaagcgggccgtggacaagtggaacagcgatctcaaggaaattttgagaggagaccggtccattccaaattttcgcaaggattgcccaattgacatcgttaaacaatcgaccaaaattcaaaaatgtaacgacggctatgtgttgtctctcggactgatcaacagggagtataagaatgaacttggaagaaaaaacggggtgtttgatgttttgatcaaagctaacgataagactcaacaaaccatattggagcgcatcataaatggtgattacacttatactgcgtcacaaattataaatcacaagaacaagtggtttattaatcttacttatcaatttgaaactaaagagacagcgctggacccaaacaatgttatgggggttgcgttgggtatagtttatccagtttatattgcttttaataacagcttgcatcgctatcacatcaaaggtggcgaaattgagaggttcaggcggcaggtggaaaagagaaagagggagttgctcaatcaaggtaagtattgtggcgacgggaggaaaggccacggttatgccacgcggacgaaaagcatagaatcaatctctgataagattgctcggttcagggatacgtgtaatcataagtattcgaggtttatagtggacatggccctcaaacataattgtggaatcatacagatgaacgacttgaccggtatttcaaaggagtcaacgttcctgaagaactggacatactacgatcttcaacagaaaattgaatataaagctagggaggcgggtatccaagttatcaaaattgagccgcaatacacctcacagcgctgctccaagtgcggctatatcgacaaggaaaaccggcaagaacaagctacattcaagtgcatcgaatgcgggttcaaaaccaatgctgcttacaatgccgctcggaatatcgccattccaaatatagataagataatcagaaagacgctgaagatgcaaacgtgcgccaaggacatccaaaaagcagccgcggaggcggcactcgcctttcaggacgagacctgcgacaccaccaccaccaaccacggcctcgacatggaggagaccatggtcgaagccatctacacccccgagcagagcgagggcgccttctacatggacgaagagacaatgttcggcatgccaaccctcctcgacaacatggccgaaggcatgctgctgccgcccccgagcgtccagtggaaccacaactacgacggcgaaggcgacggggatgtgtccctgtggagctactag

SEQ ID NO: 235 - protein, 572 aa, Artificial Sequence
  dCas?7-GNAT1
MKYTKVMRYQIIKPLNAEWDELGMVLRDIQKETRAALNKTIQLCWEYQGFSADYKQIHGQYPKPKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVALGIVYPVYIAFNNSLHRYHIKGGEIERFRRQVEKRKRELLNQGKYCGDGRKGHGYATRTKSIESISDKIARFRDTCNHKYSRFIVDMALKHNCGIIQMNDLTGISKESTFLKNWTYYDLQQKIEYKAREAGIQVIKIEPQYTSQRCSKCGYIDKENRQEQATFKCIECGFKTNAAYNAARNIAIPNIDKIIRKTLKMQMTCLVAVNSNSVNSSFNIECGDATDANFEKYNLSRGSVAGILTLDTVADYLPRRGPLKQRRTGIAYIANVAVRKEERRKGIAKMLVQEAEARARSWGCRSMALHCDVNNVAALRLYRNQGFKCIRVPEGAKWPEPKIAKGAEYNFMMK

SEQ ID NO: 236 - protein, 573 aa, Artificial Sequence
  dCas?7-GNAT2
MKYTKVMRYQIIKPLNAEWDELGMVLRDIQKETRAALNKTIQLCWEYQGFSADYKQIHGQYPKPKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVALGIVYPVYIAFNNSLHRYHIKGGEIERFRRQVEKRKRELLNQGKYCGDGRKGHGYATRTKSIESISDKIARFRDTCNHKYSRFIVDMALKHNCGIIQMNDLTGISKESTFLKNWTYYDLQQKIEYKAREAGIQVIKIEPQYTSQRCSKCGYIDKENRQEQATFKCIECGFKTNAAYNAARNIAIPNIDKIIRKTLKMQMNDGVDEHMIWLVGLKNIFARQLPNMPKEYIVRLVMDRTHKSMMVIRNNIVVGGITYRPYASQRFGEIAFCAITADEQVKGYGTRLMNHLKQHARDADGLTHFLTYADNNAVGYFVKQGFTKEITLDKERWQGYIKDYDGGILMECKID

SEQ ID NO: 237 - protein, 809 aa, Artificial Sequence
  dCas?7-HAT1
MKYTKVMRYQIIKPLNAEWDELGMVLRDIQKETRAALNKTIQLCWEYQGFSADYKQIHGQYPKPKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVALGIVYPVYIAFNNSLHRYHIKGGEIERFRRQVEKRKRELLNQGKYCGDGRKGHGYATRTKSIESISDKIARFRDTCNHKYSRFIVDMALKHNCGIIQMNDLTGISKESTFLKNWTYYDLQQKIEYKAREAGIQVIKIEPQYTSQRCSKCGYIDKENRQEQATFKCIECGFKTNAAYNAARNIAIPNIDKIIRKTLKMQMEVGTRVMCRWRDQKLHPVKVIERRKGSACSSPADYEYYVHYTEFNRRLDEWVKLDQLDLDTVETVVDEKVEDKATSLKMTRHQKRKIDETHVEQGHEELDAASLREHEEFTKVKNIAKIELGRYEIDTWYFSPFPPEYNDCPKLFFCEFCLNFMKRKEQLQRHMKKCDLKHPPGDEIYRSGTLSMFEVDGKKNKVYGQNLCYLAKLFLDHKTLYYDVDLFLFYVLCECDDRGCHMVGYFSKEKHSEESYNLACILTLPPYQRKGYGKFLIAFSYELSKKEGKVGTPERPLSDLGLLSYRGYWTRVLLEILKKHKGNISIKELSDMTAIKADDILSTLQSLDLIQYRKGQHVICADPKVLDRHLKAAGRGGLDVDVSKLIWTPYK

SEQ ID NO: 238 - protein, 881 aa, Artificial Sequence
  dCas?7-HAT2
MKYTKVMRYQIIKPLNAEWDELGMVLRDIQKETRAALNKTIQLCWEYQGFSADYKQIHGQYPKPKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVALGIVYPVYIAFNNSLHRYHIKGGEIERFRRQVEKRKRELLNQGKYCGDGRKGHGYATRTKSIESISDKIARFRDTCNHKYSRFIVDMALKHNCGIIQMNDLTGISKESTFLKNWTYYDLQQKIEYKAREAGIQVIKIEPQYTSQRCSKCGYIDKENRQEQATFKCIECGFKTNAAYNAARNIAIPNIDKIIRKTLKMQMMALKQKDTDAAATATGTKKRRRVFFSDTDAGVEANECMKVFLVWNPGEVSSVDCTAIQPFDLNHFFGEDGKIYGYKNLKINVWISAKSFHGYADVSFDETSDGGKGITDLKPVLQNIFGENLVEKEEFLHTFSKECEYIRTAVTNGSAIKHDGSYESDPAVEIVRVELQGAAAFLYSRLVPLVLLLVEGSTPIDIGEHGWEMLLVVKKATQEAGSKFELLGFAAVHNFYHYPESIRLRISQILVLPPYQGEGHGLGLLEAINYIAQSENIYDVTIESPSDYLQYVRSSIDCLRLLMFDPIKPALGAIVLSLKETNLSKRAQSLRMVPPADLMETVRQKLKINKKQFLRCWEILIFLSLDSQDHKSMDNFRACIYDRMKGEILGSASGTNRKRLLQMPTSFNKEASFAVYWTQEIEDEDEQTVEQQPEDLKTQEQQLNELVDIQIEEIAGVAKNVTS

SEQ ID NO: 239 - protein, 541 aa, Artificial Sequence
  dCas?7-jmj
MKYTKVMRYQIIKPLNAEWDELGMVLRDIQKETRAALNKTIQLCWEYQGFSADYKQIHGQYPKPKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVALGIVYPVYIAFNNSLHRYHIKGGEIERFRRQVEKRKRELLNQGKYCGDGRKGHGYATRTKSIESISDKIARFRDTCNHKYSRFIVDMALKHNCGIIQMNDLTGISKESTFLKNWTYYDLQQKIEYKAREAGIQVIKIEPQYTSQRCSKCGYIDKENRQEQATFKCIECGFKTNAAYNAARNIAIPNIDKIIRKTLKMQWLYVGMCFSSFCWHVEDHHLYSLNYMHWGAPKMWYGVPGKDAVNLEAAMRKHLPDLFEEQPDLLHNLVTQFSTSLLKSEGVPVYRCVQHEGEFVLTFPRAYHAGFNCGFNCAEAVNV

SEQ ID NO: 240 - protein, 522 aa, Artificial Sequence
  dCas?7-CBF1a
MKYTKVMRYQIIKPLNAEWDELGMVLRDIQKETRAALNKTIQLCWEYQGFSADYKQIHGQYPKPKDVLGYTSMHGYAYDRLKNEFSKIASSNLSQTIKRAVDKWNSDLKEILRGDRSIPNFRKDCPIDIVKQSTKIQKCNDGYVLSLGLINREYKNELGRKNGVFDVLIKANDKTQQTILERIINGDYTYTASQIINHKNKWFINLTYQFETKETALDPNNVMGVALGIVYPVYIAFNNSLHRYHIKGGEIERFRRQVEKRKRELLNQGKYCGDGRKGHGYATRTKSIESISDKIARFRDTCNHKYSRFIVDMALKHNCGIIQMNDLTGISKESTFLKNWTYYDLQQKIEYKAREAGIQVIKIEPQYTSQRCSKCGYIDKENRQEQATFKCIECGFKTNAAYNAARNIAIPNIDKIIRKTLKMQTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 241 - DNA, 4790 bp, Artificial Sequence
  dCas?7-HAT1 expression cassette
gcggccgcatcgagcagctggcttgtggggaccagacaaaaaaggaatggtgcagaattgttaggcgcacctaccaaaagcatctttgcctttattgcaaagataaagcagattcctctagtacaagtggggaacaaaataacgtggaaaagagctgtcctgacagcccactcactaatgcgtatgacgaacgcagtgacgaccacaaaactcgagcaacgagatcatgagccaatcaaagaggagtgatgtagacctaaagcaataatggagccatgacgtaagggcttacgcccatacgaaataattaaaggctgatgtgacctgtcggtctctcagaacctttactttttatgtttggcgtgtatttttaaatttccacggcaatgacgatgtgaccgtcgacccactaaaacattgctttgtcaaaagctaaaaaagatgatgcccgacagccacttgtgtgaagcatgagaagccggtccctccactaagaaaattagtgaagcatcttccagtggtccctccactcacagctcaatcagtgagcaacaggacgaaggaaatgacgtaagccatgacgtctaatcccatctagatgctttaccgcgtgctatggccaagacactcggcaaactaggctcctttgtcgagttccatcccaagcactcgacattggaactgcgactgggcctcacagaagctttctttgccgagtgccactaagcgaggaactcggatgctcagcaaaggctctgtcatcgtcacgatgtcttttgtttgtcgtgtaccagttggcactcggtaaagactttactgagtgcccgatagaaagtactcgacaaagagaccgttgccaacgtttggttcactgagggctctttgctgccttttggacttgacaaagaagccgtctccagtagtgtctcctgggaggcgggatttatgttttttcccggagctctgtgggacatcatggacggtccagtctggtgatctaaaatagacggtttgccaagctcacagagaagtctttaagatcttccacgatgcacgcatgctttaaggttagttagtgtttggtctgaaaaagcgtcaacaattaggaaacaagaactaaaattattaaaggacagatcaggaagcatgcatgttcttcttctatagtgtgtgttgagcctgagtttggccttttaggctttattagggggctcacagtctaactaaggagttgtattgatgtgctgacaaatattatgttcgatcgtcacagtgttcttatgcggatcgattaggcccgatcatggtgaaataaactaaccaccggtaagtccgggcagccctagagcatgcagcggcctacgtgaagcccgcacatcgcatcgtcgtccgtcaggcgctaacggccggccgctgcatgcgtcgccggcgaactctctgctgagccacccgtcctccctataagtagctatcccagcaccgtcgtctatcaaccacacacagagcggcatttcgaataacacaggtgagcgcgacgacccgtcctccctataagtagctatcccagcaccgtcgtctatcaaccacacacagagcggcatttcgaataacacaggtgagcgcgacggtcgactctagaggatccatggcaccgaagaagaagcgcaaggtgatgaaatacacaaaagtcatgcgctatcagatcattaagcccttgaatgccgagtgggacgagcttggtatggtcttgcgggatattcaaaaagaaactagggctgcgctgaacaaaactatccaactctgctgggaataccagggcttcagcgcagactacaagcaaatccacgggcaatatccgaaacctaaagacgttctgggatatacttccatgcatggctatgcctacgaccggcttaagaatgagttttcgaaaattgcatccagcaacttgtcccaaaccataaagcgggccgtggacaagtggaacagcgatctcaaggaaattttgagaggagaccggtccattccaaattttcgcaaggattgcccaattgacatcgttaaacaatcgaccaaaattcaaaaatgtaacgacggctatgtgttgtctctcggactgatcaacagggagtataagaatgaacttggaagaaaaaacggggtgtttgatgttttgatcaaagctaacgataagactcaacaaaccatattggagcgcatcataaatggtgattacacttatactgcgtcacaaattataaatcacaagaacaagtggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtttattaatcttacttatcaatttgaaactaaagagacagcgctggacccaaacaatgttatgggggttgcgttgggtatagtttatccagtttatattgcttttaataacagcttgcatcgctatcacatcaaaggtggcgaaattgagaggttcaggcggcaggtggaaaagagaaagagggagttgctcaatcaaggtaagtattgtggcgacgggaggaaaggccacggttatgccacgcggacgaaaagcatagaatcaatctctgataagattgctcggttcagggatacgtgtaatcataagtattcgaggtttatagtggacatggccctcaaacataattgtggaatcatacagatgaacgacttgaccggtatttcaaaggagtcaacgttcctgaagaactggacatactacgatcttcaacagaaaattgaatataaagctagggaggcgggtatccaagttatcaaaattgagccgcaatacacctcacagcgctgctccaagtgcggctatatcgacaaggaaaaccggcaagaacaagctacattcaagtgcatcgaatgcgggttcaaaaccaatgctgcttacaatgccgctcggaatatcgccattccaaatatagataagataatcagaaagacgctgaagatgcaaaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctgaggtgggcacgcgcgtgatgtgccggtggcgcgaccagaagctccacccggtcaaggtgatcgagcgccgcaagggctccgcgtgctcttcccccgccgactacgagtattacgtccactacaccgagttcaatagaagacttgacgagtgggttaagcttgatcagcttgatcttgacactgtcgagaccgttgtcgatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatatcgcgaagatcgaactggggagatatgagatagacacatggtatttctctccttttccaccagagtataatgactgcccgaagctgtttttctgtgaattttgcctcaacttcatgaagcgcaaagaacagcttcagaggcacatgaagaagtgtgatcttaagcaccccccaggtgatgaaatctatagaagtggaactctatcaatgttcgaggttgatgggaagaagaacaaggtttatggacagaacctttgttatctggctaagctatttcttgatcacaagacattgtactatgatgttgatttgttcttgttttatgtcctctgcgaatgtgatgatcggggatgtcatatggtgggatatttctctaaggaaaaacactccgaagaatcttataatttggcttgcattctcactctccccccataccaaagaaaaggatatgggaagttcctgattgctttctcatatgaactttccaagaaagaaggtaaagttgggacaccggagcgccctctctctgatcttggtctgctcagctatagaggttattggactagagtgcttctggaaattctaaagaaacataagggaaacatatctataaaggaactaagcgacatgacggcaataaaagcagatgacatattgagcacgctacagagcctggacctaatccagtaccgcaaagggcagcacgtcatctgcgctgacccgaaggtcctcgaccgccacctcaaggcggcggggcggggcggcctggacgtcgacgttagcaagctcatatggactccctacaagtaggcggccgcaactagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcggcgcgccccatgg

SEQ ID NO: 242 - DNA, 297 bp, Arabidopsis thaliana
acctgcgccaaggacatccagaaagcagccgccgaagcggccctcgccttccaagacgagacgtgcgatacaaccaccacgaatcatggcctcgatatggaggaaacgatggtcgaagccatctacaccccagagcagtcagaaggcgccttctacatggacgaggaaaccatgttcggcatgccgaccctcctcgacaacatggccgaaggaatgctcctcccacctccctcagttcagtggaaccacaactacgacggcgaaggcgacggagacgtttccctgtggagctactag

SEQ ID NO: 243 - protein, 98 aa, Arabidopsis thaliana
TCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 244 - DNA, 1569 bp, Artificial Sequence
  VP64
gacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgacatggacttctccgcactgctgggtagcggatcgggatctcgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttt

SEQ ID NO: 245 - protein, 523 aa, Artificial Sequence
  VP64
DALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 246 - DNA, 879 bp, Arabidopsis thaliana
atggagcctcctcagcaccaacatcaccaccatcaggccgatcaagagtccgggaacaacaacaacaacaagtccggttccggagggtacacttgcagacagacctccaccagatggacacctaccactgagcagatcaagatcctgaaggagttgtactacaacaatgccatccgctcccctactgctgatcagattcagaagatcaccgctcgcctgcgtcaattcggtaagatcgagggtaagaacgtcttctactggttccagaaccacaaggctcgtgagaggcagaagaagcgtttcaacgggactaacatgaccactccttcctcatcacccaattctgttatgatggccgccaacgaccactaccatcctttgcttcatcaccaccacggagttcctatgcaaagacccgcaaactccgtcaacgtgaagttgaaccaggaccatcacctctaccaccacaacaagccctacccctctttcaacaacgggaatctcaaccatgcctcctctggaaccgaatgtggagttgtcaacgcctccaacggctacatgtcttcccacgtgtacggctctatggagcaagattgctccatgaactacaacaacgttggaggcggatgggcaaacatggatcaccactactcctccgctccctacaacttcttcgatagggctaaacctctcttcggcttggagggacaccaagaagaagaggaatgcggaggtgatgcttacttggaacacagaaggactctccctctctttccaatgcacggtgaggaccacatcaacggaggatctggcgctatctggaagtatggacagtccgaggtcagaccatgcgcttccctggaattgagactgaactag

SEQ ID NO: 247 - protein, 292 aa, Arabidopsis thaliana
MEPPQHQHHHHQADQESGNNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQEEEECGGDAYLEHRRTLPLFPMHGEDHINGGSGAIWKYGQSEVRPCASLELRLN

SEQ ID NO: 248 - DNA, 876 bp, Lotus japonicus
atggaacaaccacctcaacaacaacaacagaatgaggatggtggtgggagtagtggtggaaaaggggggtttctgagcaggcaaagcagtacacggtggactcccaccacagaccagataagaatattgaaggagctttactacaacaatggaataagatccccgagtgcagagcagattcagaggatctctgctcggctgagacagtacggcaagattgaaggcaagaatgtcttttactggttccagaaccacaaagctagagagaggcagaagaaaaggttcacttctgaaactcatcttcttcccaatcccatacaacaacaacaaagaaatggaactaatgctgcttggaagcaacctgaagaacaacccattattaaccacaccaagtattctagtaacaacatttcagctcctgcagggatcatcacttctgctccatcttcttctgcagagattgtttctgttggccagataggaaactttggttatggatctttgcctatggaaaagagttttagggactgctcaatatctgctggaggcaacacaggctatgctggaagtgctataaaccacaacctgggatggatgggtgtggatccatattcctcagcctacaccaatttctttgacaaaataaggccaactgaagaagaaaccatggaagaagaaggacaagagaatggttcaccagagattgaaacccttcctttattcccgatgcatggtgaggacattcatagtggctatttcaacctcaagtctaattcttctcactatgctggtggctggtaccagactgaagaagggtacttcaacaatggttctcgtgcttccttggagctcagcctcaaatatcctgattttgct

SEQ ID NO: 249 - protein, 292 aa, Lotus japonicus
MEQPPQQQQQNEDGGGSSGGKGGFLSRQSSTRWTPTTDQIRILKELYYNNGIRSPSAEQIQRISARLRQYGKIEGKNVFYWFQNHKARERQKKRFTSETHLLPNPIQQQQRNGTNAAWKQPEEQPIINHTKYSSNNISAPAGIITSAPSSSAEIVSVGQIGNFGYGSLPMEKSFRDCSISAGGNTGYAGSAINHNLGWMGVDPYSSAYTNFFDKIRPTEEETMEEEGQENGSPEIETLPLFPMHGEDIHSGYFNLKSNSSHYAGGWYQTEEGYFNNGSRASLELSLKYPDFA

SEQ ID NO: 250 - DNA, 888 bp, Glycine max
atggaacctcaacaacaacaacaacaagcacaagggagccaacaacaacaacaaaacgaggatggtggcagtggaaaaggggggtttctgagcaggcaaagtagtacacggtggactccaacaaacgaccagataagaatattgaaggaactttactacaacaatggaattagatccccgagtgcagagcagattcagaggatctctgctaggctgaggcagtacggtaagattgaaggcaagaatgtcttttattggttccagaaccacaaagctcgagaaaggcagaagaaaaggttcacttctgatcataatcataataatgtccccatgcaaagacccccaactaatccttctgctgcttggaaacctgatctagctgatcccattcacaccaccaagtattgtaacatctcttctactgcagggatctcttcggcatcatcttctgttgagatggttactgtgggacagatggggaattatgggtatggttctgtgcctatggagaaaagttttagggactgctcgatatcagctgggggtagcagtggccatgttggattaataaaccacaacttggggtgggttggtgtggacccatataattcctcaacctatgccaacttctttgacaaaataaggccaagtgatcaagaaacccttgaagaagaagcagagaacattggtgctactaagattgaaaccctccctttattccctatgcacggtgaggacatccacggctattgcaacctcaagtctaattcgtataactatgatggaaacggctggtatcatactgaagaagggttcaagaatgcttctcgtgcttccttggagctcagtctcaactcctacactcgcaggtctccagattatgcttaa

SEQ ID NO: 251 - protein, 295 aa, Glycine max
MEPQQQQQQAQGSQQQQQNEDGGSGKGGFLSRQSSTRWTPTNDQIRILKELYYNNGIRSPSAEQIQRISARLRQYGKIEGKNVFYWFQNHKARERQKKRFTSDHNHNNVPMQRPPTNPSAAWKPDLADPIHTTKYCNISSTAGISSASSSVEMVTVGQMGNYGYGSVPMEKSFRDCSISAGGSSGHVGLINHNLGWVGVDPYNSSTYANFFDKIRPSDQETLEEEAENIGATKIETLPLFPMHGEDIHGYCNLKSNSYNYDGNGWYHTEEGFKNASRASLELSLNSYTRRSPDYA

SEQ ID NO: 252 - DNA, 897 bp, Camelina sativa
atggagccaccgcagcatcagcatcatcaccatcaagccgaccaagaaagcggcaataacaacaagtccggttctggtggttacacttgtcgccaaaccagcacgaggtggacaccaacgacggagcagatcaaaatgctcaaagagctttattacaatagtggaatccggtcaccaacagcagatcagatccagaagatcactgctaggctgcgacagttcggaaagatcgagggcaagaacgtcttttactggttccagaaccacaaggctcgtgagcgtcagaagaagagattcaacggcacaaccatgaccacaccgtcttcatctcccaactcggttatgatggctaatgatcattatcatcaacatctccctctacttcaccatcatcatggcgttcccatgcagagacctgcgaactccgtcaacgttaaacttaaccaagagcatcatctctatcatcagaacaagtcatatcccagcttcaataacgggaatttaaatcatgcaagctcaggtactgaatgtggtgctgttaatgcttctaatggctactcaagtagccatatctatggatctatggaacaagactgttctatgaattacaacaacgtaggtggaggatggacggcaaacatggatcataatcatcattactcatcagcaccttacaacttcttcgatagaccaaaacctccgtttggtctagacggtcatcaggaagaagaagaatgtggtggcgatgcttatctggaacatcgacgtacgcttcctctcttccctatgcatggtgaagatcacataaatggtgccagctggaagtatggccaactggacggtcatgattgtcatggtagaggcccttgcgcttctcttgagcttcgtttgaactag

SEQ ID NO: 253 - protein, 298 aa, Camelina sativa
MEPPQHQHHHHQADQESGNNNKSGSGGYTCRQTSTRWTPTTEQIKMLKELYYNSGIRSPTADQIQKITARLRQFGKIEGKNVFYWFQNHKARERQKKRFNGTTMTTPSSSPNSVMMANDHYHQHLPLLHHHHGVPMQRPANSVNVKLNQEHHLYHQNKSYPSFNNGNLNHASSGTECGAVNASNGYSSSHIYGSMEQDCSMNYNNVGGGWTANMDHNHHYSSAPYNFFDRPKPPFGLDGHQEEEECGGDAYLEHRRTLPLFPMHGEDHINGASWKYGQLDGHDCHGRGPCASLELRLN

SEQ ID NO: 254 - DNA, 897 bp, Capsella rubella
atggagccaccacagcatcagcatcatcatcatcaagccgaccaagaaagcggcaacaacaacaacaagtccggctctggtggctacacgtgtcgccaaaccagcactaggtggacaccaacgacggagcagatcagaatcctcaaggatctttactacaacagtgcgatccggtcaccaacagccgatcagatccagaagatcaccgcgaggctgagacagtacgggaagatcgaaggcaagaacgtcttttactggttccagaaccataaggctcgtgagcgtcagaagaagagattcaacggcacaaccatgaccactccatcttcatctcccaactcggttatggtggctaatgatcactatcatcctctacttcaccatcatcatggtgttcccatgcaaaggcctgctaactccgtcaacgtcaaacttaaccaagaccatcatctctatcatcagaacaagtcatatcccaccttcaacaatgggaatttaaatcatggaagctcaggtactgaatgtggtgttgttaatgcttctaatggctacatgagtagccatgtctatggatctatggaacaagactgttcaatgaactacaacaacgtaggtactggaggatacggatcaaacatggatcatagtcatcattactcatctgcaccatacaacttctttgatagatcaaagcctctctttggtctagaaggtcatcaagaagatgaagaagaatatggtataggcgatgcttatctggaacatcgacgtacgcttcctctcttccctatgcatggtgaagatcacatgaacggtagtggtgctagctggaagtttgatggccgtgattgccatggtagaggcccttgcgcttctcttgagcttcgtctgaactag

SEQ ID NO: 255 - protein, 298 aa, Capsella rubella
MEPPQHQHHHHQADQESGNNNNKSGSGGYTCRQTSTRWTPTTEQIRILKDLYYNSAIRSPTADQIQKITARLRQYGKIEGKNVFYWFQNHKARERQKKRFNGTTMTTPSSSPNSVMVANDHYHPLLHHHHGVPMQRPANSVNVKLNQDHHLYHQNKSYPTFNNGNLNHGSSGTECGVVNASNGYMSSHVYGSMEQDCSMNYNNVGTGGYGSNMDHSHHYSSAPYNFFDRSKPLFGLEGHQEDEEEYGIGDAYLEHRRTLPLFPMHGEDHMNGSGASWKFDGRDCHGRGPCASLELRLN

SEQ ID NO: 256 - DNA, 588 bp, Arabis alpina
atggctactcatgtagccattagaagcattaacagcaccacattcagaacctgaacttgcatgatttaaattcccgttattgaagctgggatatgatttgttctgatgaagcagatggtgttcttggtcatgaagcttaacgttgagagaagcaggtctctgcatggaaacaccatgatgatgttgaagaagaggatgatgatgatggttatgatgataacgatcactggccatcataactgagttgggcgatgaagacgttggtgtggtggtcatggttgtgccattgaatctcttcttctgacgctcacgagccttatggttctgaaaccagtaaaagacgtttttgccctcgatcttaccatattgtctcagccttgcagagatcttctggatctcatcagcagttggtgaccggattccactattgtagtaaagatctttgaggattctgatttgctccgtggttggagtccatctcgtgctggtttgacgacaagtgtaaccaccagaaccggacttgttgttgttgttgccgctttcttggtcggcttgatgatgatgatgatgatgttgcggtggctccat

SEQ ID NO: 257 - protein, 304 aa, Arabis alpina
MEPPQHHHHHHQADQESGNNNNKSGSGGYTCRQTSTRWTPTTEQIRILKDLYYNSGIRSPTADEIQKISARLRQYGKIEGKNVFYWFQNHKARERQKKRFNGTTMTTTPTSSSPNSVMMASDRYHHNHHHHPLLQHHHGVSMQRPASLNVKLHDQEHHLLHQNKSYPSFNNGNLNHASSGSECGAVNASNGYMSSHVYGSMEQDYSMSNNNIGGGGWSNMDHNHHYSSPAYNFFDRPKPLFGLEGHQEEDQYGGDAYLEHRRTLPLFPMHGEDHINGGGGAIWKYRQLDGLELRLNSYAGVAPE

SEQ ID NO: 258 - DNA, 873 bp, Raphanus sativus
atggagccaccgcaacattaccatcaagccgatcaagaaagcggcaacaacaacaagtccgtctctggtggttacacgtgtcgtcaaacgagcacaagatggacaccaacaaccgatcaaatcagaatactcaaagatctttactacaacaatggagtccggtcaccaacagccgaccagatccagaagatctctgcaacgctgagacagtacggaaaaatcgagggaaaaaatgtcttttactggtttcaaaaccataaggctcgtgagcgacagaagaagagattcaacagcacaaccatggccacaccaacgtcttcatcgcccaactcggttatgatgatggctagtgatcaccatcatcatcatggtgttaccatccagagacctgctttggtcaacgttaagctcgaccaagaaaatcatatgtttcaccagaacagatcatatcccagctccaataacgggagtataaatcatgcaagttcaggcacggaatatggtgttttcggcgcttctaatggctacattagtaaccatatctatggatctatggaacaagactgttcaatgagctacaacagcgtaggtggaggatggacaaacatggatcataatcatcattactcaactccagcttacaacttctttgatagaccatcgcctctgtctggactagaaggtcatcaagaagaaggacaatatggtggcgattcttatctggaacatcgacgtacacttcctctcttccctttgcacggtgaggatcacatcaacggtggtggtggttccatcttgaagtacggacaatcagacggttgtgatcgttatggtagaggcccttgtgcttctcttaagctatgtctgaactga

SEQ ID NO: 259 - protein, 290 aa, Raphanus sativus
MEPPQHYHQADQESGNNNKSVSGGYTCRQTSTRWTPTTDQIRILKDLYYNNGVRSPTADQIQKISATLRQYGKIEGKNVFYWFQNHKARERQKKRFNSTTMATPTSSSPNSVMMMASDHHHHHGVTIQRPALVNVKLDQENHMFHQNRSYPSSNNGSINHASSGTEYGVFGASNGYISNHIYGSMEQDCSMSYNSVGGGWTNMDHNHHYSTPAYNFFDRPSPLSGLEGHQEEGQYGGDSYLEHRRTLPLFPLHGEDHINGGGGSILKYGQSDGCDRYGRGPCASLKLCLN

SEQ ID NO: 260 - DNA, 885 bp, Brassica napus
atggagccagcgcaacatcaccatcaagccgaccaagaaagcggcaacaacaacaagtccgtctctggtggttacacgtgtcgtcaaacgagtacaagatggacaccaacgaccgatcaaatcagaatactcaaagatctttactacaacaacggagtccggtcaccaacagccgaccagatccagaagatctctgcaaggctgagacagtacggaaagatcgagggaaaaaatgtcttttactggtttcaaaaccataaggctcgtgagcgacagaagaagagattcaacagcacaaccatgaccataccaacgtcttcatcgcccaactcggttatgatggctagtgatcactatcaccataaccatcatcatcatggcgttaccatccagagacctgctttggtcaacgttaagctcgaccaagaaaatcatatgtttcatcagaacagatcatatcccagcttcaataacgggaatacaaatcatgcaagttcaggcacggaatatggtgttttcagtgcttctaatggctacattagtagccatatctatgaacctatggaacaagactgttcaatgagctacaacaacgtaggtggaggatggacaaacatagatcataatcaccattactcaactccagcctacaacttcttagatagaccaatgcctctgtctggactagaaggtcatcatcaagaagaaggagaatatggtggcgatgcttatctggaacatagacgcacacttcctctcttccctttgcacggtgaggatcacatcaacggcggtggtggttccatctggaagtacagacaatcggacggttgtgatcgttatggtagaggcccttgtgcttctcttaagctgtgtctgaactga

SEQ ID NO: 261 - protein, 294 aa, Brassica napus
MEPAQHHHQADQESGNNNKSVSGGYTCRQTSTRWTPTTDQIRILKDLYYNNGVRSPTADQIQKISARLRQYGKIEGKNVFYWFQNHKARERQKKRFNSTTMTIPTSSSPNSVMMASDHYHHNHHHHGVTIQRPALVNVKLDQENHMFHQNRSYPSFNNGNTNHASSGTEYGVFSASNGYISSHIYEPMEQDCSMSYNNVGGGWTNIDHNHHYSTPAYNFLDRPMPLSGLEGHHQEEGEYGGDAYLEHRRTLPLFPLHGEDHINGGGGSIWKYRQSDGCDRYGRGPCASLKLCLN

SEQ ID NO: 262 - DNA, 885 bp, Brassica oleracea
atggagccagcgcaacatcaccatcaagccgaccaagaaagcggcaacaacaacaagtccgtctctggtggttacacgtgtcgtcaaacgagtacaagatggacaccaacgaccgatcaaatcagaatactcaaagatctttactacaacaacggagtccggtcaccaacagccgaccagatccagaagatctctgcaaggctgagacagtacggaaagatcgagggaaaaaatgtcttttactggtttcaaaaccataaggctcgtgagcgacagaagaagagattcaacagcacaaccatgaccataccaacgtcttcatcgcccaactcggttatgatggctagtgatcactatcaccataaccatcatcatcatggcgttaccatccagagacctgctttggtcaacgttaagctcgaccaagaaaatcatatgtttcatcagaacagatcatatcccagcttcaataacgggaatataaatcatgcaagttcaggcacggaatatggtgttttcagtgcttctaatggctacattagtagccatatctatggacctatggaacaagactgttcaatgagctacaacaacgtaggtggaggatggacaaatatagatcataatcaccattactcaactccagcctacaacttcttagatagaccaatgcctctgtctggactagaaggtcatcatcaagaagaaggagaatatggtggcgatgcttatctggaacatagacgcacacttcctctcttccctttgcacggtgaggatcacatcaacggcggtggtggttccatctggaagtacagacaatcggacggttgtgatcgttatggtagaggcccttgtgcttctcttaagctgtgtctgaactga

SEQ ID NO: 263 - protein, 294 aa, Brassica oleracea
MEPAQHHHQADQESGNNNKSVSGGYTCRQTSTRWTPTTDQIRILKDLYYNNGVRSPTADQIQKISARLRQYGKIEGKNVFYWFQNHKARERQKKRFNSTTMTIPTSSSPNSVMMASDHYHHNHHHHGVTIQRPALVNVKLDQENHMFHQNRSYPSFNNGNINHASSGTEYGVFSASNGYISSHIYGPMEQDCSMSYNNVGGGWTNIDHNHHYSTPAYNFLDRPMPLSGLEGHHQEEGEYGGDAYLEHRRTLPLFPLHGEDHINGGGGSIWKYRQSDGCDRYGRGPCASLKLCLN

SEQ ID NO: 264 - DNA, 882 bp, Helianthus annuus
atggaaactcaacaacaacaagcagatattcaagattttgggaacaaaaacagtaacacctatgcatgcaggcaaagcagtactaggtggacacccacaagtgatcagatcagaatactgaaagagctctactacaacaatggaatcagatcaccaactgctgatcagattcagagaatcgctgctcaactcagacagtacggcaagattgaaggcaagaacgtgttttattggtttcagaaccataaagctcgtgaacgccagaagaaacggttcactcctactgctcctccaccaccgtctcacttctccgatcatattaaccaccatcttcccaacgctgcccccatgcagattccgtctcaccaccaccactaccaccatcaagaaccaccacatgtctatgctcaccctcacaaactctacaccactcatcacattggggttggttcttcttcacaaggagtgatgggtgtagggtgtggctatggatctgttgctatggagaagagtttcaggaagtgttcaatatcaccaccgggagagagtaaggccacaggaggaattggccggaatatcggttcaagatcacggataagtgtcgattcgtgttccttcttcgacacaattaagccaaagacatatgagatgtttgagaatcatgatcaagatgaagaacaaggagagccttcaactgagatcgaaacacttccattattcccgattcacgacggcaaccatcatgatttcttcggcatgaggacggcaaatctgcaattggagcaaggcactggaggttactacactggaggaagctggtatcggtctgatgagagggcgtctcttgagctcagtctcaactcatatggttattataactaa

SEQ ID NO: 265 - protein, 293 aa, Helianthus annuus
METQQQQADIQDFGNKNSNTYACRQSSTRWTPTSDQIRILKELYYNNGIRSPTADQIQRIAAQLRQYGKIEGKNVFYWFQNHKARERQKKRFTPTAPPPPSHFSDHINHHLPNAAPMQIPSHHHHYHHQEPPHVYAHPHKLYTTHHIGVGSSSQGVMGVGCGYGSVAMEKSFRKCSISPPGESKATGGIGRNIGSRSRISVDSCSFFDTIKPKTYEMFENHDQDEEQGEPSTEIETLPLFPIHDGNHHDFFGMRTANLQLEQGTGGYYTGGSWYRSDERASLELSLNSYGYYN

SEQ ID NO: 266 - DNA, 795 bp, Populus trichocarpa
atggaacctcaccaacaacaaccaaatgaggataataacggtggcgccaaagggaactttctttgcaggcaaaccagtacaaggtggaatcccactactgaccagataagaatattgaaggaactgtactacatcaaaggtgttaggtccccaaatggagctgagattcagcagatctctgctaggcttagaaagtacggcaagattgaaggcaagaatgtattttattggtttcagaaccataaagctcgtgagaggcaaaagaaaagactcaccaatgaagtccccatgcaacaaagaactgcctggaaacctgaagattattactcttacaagtactccaacagtaataataatcctgggttttcttcggcttcttcatctgcaaataccggtgtggttactgttgggcagacagatagccatggatatggatcggtaaccatgcaggagaagaattcttgggactgttcagcaccagctggtggtagcaatggtgctggtagtggatccatgagcaatattaactatggatcaggggttgacattaactctcacagttcatcctatgctgtatttggtcaagaacaagaagcagctgcaaagattgagactcttcctctatttccaatgcttggtgaggacatcagtagctctttcaacatcaacaatatcaacccagacttttattacagtagcggctgtggctatggtgattatggcaatgacacttcttcccgtacttccctggaccttagtctctactcctacaatggccaaccacaagattattaa

SEQ ID NO: 267 - protein, 264 aa, Populus trichocarpa
MEPHQQQPNEDNNGGAKGNFLCRQTSTRWNPTTDQIRILKELYYIKGVRSPNGAEIQQISARLRKYGKIEGKNVFYWFQNHKARERQKKRLTNEVPMQQRTAWKPEDYYSYKYSNSNNNPGFSSASSSANTGVVTVGQTDSHGYGSVTMQEKNSWDCSAPAGGSNGAGSGSMSNINYGSGVDINSHSSSYAVFGQEQEAAAKIETLPLFPMLGEDISSSFNINNINPDFYYSSGCGYGDYGNDTSSRTSLDLSLYSYNGQPQDY

SEQ ID NO: 268 - DNA, 843 bp, Vitus vinifera
atggaacctcaacaacagctccagcagcagcagcaacaaaaccaacaacagccaaacgaggatagcggcagcagcaaaggcagttttctgtgcaggcaaagcagtacacgctggactcctacaactgaccagataagaatattgaaggacctttactacaacaatggagttaggtccccaagtgctgaacagattcagaggatctcagctaggctgaggcagtacggcaagatcgaaggcaagaacgtcttttattggtttcagaaccataaagctcgtgaaaggcagaagaagcgattcactactgatatgcccatgcaaagatcccttggaaatgccggttggagacctgatgatcccattcacaacaaatttcataccattcccactcctgggatatcttccccatcttcttcttcttcacccagtgtgcttgctgttgggcagatgggaagctttggatatggatctgtggagaggagttttacagactgttcaatatcagcaggtggtggtcgtggtggggttggtggatctataaaccagagcttcgaatgggttggcatggacccatattcttcatcttatgcactctttgacaagagaaaaacaatgggtgaaagcttcgaagaagagcaagaagaagaagcaactccggagattgaaacgctcccactctttcccatgcacgctgaggatatcactggcttttgcaacattaagcccgaatccgacgcctactactccggctggtacaggcccgccgacgccaagaccagttcccgcacttctcttgagcttagcctcaactcctacgccggcaggtccccggattccccctga

SEQ ID NO: 269 - protein, 280 aa, Vitus vinifera
MEPQQQLQQQQQQNQQQPNEDSGSSKGSFLCRQSSTRWTPTTDQIRILKDLYYNNGVRSPSAEQIQRISARLRQYGKIEGKNVFYWFQNHKARERQKKRFTTDMPMQRSLGNAGWRPDDPIHNKFHTIPTPGISSPSSSSSPSVLAVGQMGSFGYGSVERSFTDCSISAGGGRGGVGGSINQSFEWVGMDPYSSSYALFDKRKTMGESFEEEQEEEATPEIETLPLFPMHAEDITGFCNIKPESDAYYSGWYRPADAKTSSRTSLELSLNSYAGRSPDSP

SEQ ID NO: 270 - DNA, 879 bp, Arabidopsis thaliana; identical to SEQ ID NO: 246

SEQ ID NO: 271 - protein, 292 aa, Arabidopsis thaliana; identical to SEQ ID NO: 247

SEQ ID NO: 272 - DNA, 879 bp, Lotus japonicus
atggaacaacctccccaacagcagcaacaaaacgaagacggaggcggatcaagtgggggaaaaggagggttcctcagtaggcagtccagtactaggtggacacccaccacagaccagattcgcatcctcaaggagctctactacaacaacggaatacgctcaccctccgcagaacagatccagaggatctccgcaagactcagacagtacggcaagatcgagggcaagaacgtcttctactggttccaaaaccacaaagcccgcgaaaggcagaagaagcgcttcaccagtgagacacacttgctgcccaacccaattcagcagcaacagcgcaacggaacaaacgcagcttggaagcagccagaggagcaacccatcatcaaccacaccaagtactcctccaacaacatatccgcacccgcagggattatcacaagtgccccatcttcttccgcagaaatagtctccgtggggcagatcggaaacttcggatacggatctctgccaatggagaagtccttcagggactgcagtatctcagccggaggtaacacaggatacgccgggtctgctattaaccacaacctcggatggatgggagtcgacccatactcctctgcttacaccaacttcttcgacaaaatacgcccaacagaggaggagactatggaggaagaaggacaggagaacggctcaccagaaatcgagaccctgcctttgttcccaatgcacggagaggacatccactccggctacttcaacctcaagagtaactcatcccactacgctggcggatggtaccaaactgaggaaggctacttcaacaacggatcacgcgccagtctggagctgtccctgaagtaccctgacttcgcttag

SEQ ID NO: 273 - protein, 292 aa, Lotus japonicus; identical to SEQ ID NO: 249

SEQ ID NO: 274 - DNA, 909 bp, Medicago truncatula
atggaacaacctcagcagcagcagcaaccacagacccaacagcactctccaaacaacggaatcatggggtccagacagagttccaccagatggaccccaacaaccgaccagatccgcattctcaaagacctctactacaacaacggaataaggtctccaagtgccgagcaaatccagaggatctccgcaaggctcagacagtacgggaagatcgagggcaagaacgtcttctactggttccaaaaccacaaagccagagagcgccagaaaaagcgcttcacctccgacgtcaacgtcgtccctatcatccagcgcgcccccaacaacaatactatcataagtgccgccaactggaagcctgaccaccacgaacaacagcagaacattaatgtccacacaaaccactccacatacaacatctcctccgctggcctcagttctgcttcctgctcctcagcagaaatggtcactgtggggcaaataggcaactacggctacgggtctgtcccaatggagaagtctttccgcgaatgcaccatctcagctggatgctcatcatcccaggttggctcaaccataaacccccacatcggctggatcggacaccacgtcgacccatattcaagtgcctacgctaacctcttcgagaaaatacgccccaacgaggagatcatggaagagtacgaccagggacaggaaaacggttccccagagatcgagacactcccactcttccctatgcacggagaagacatccacggagggtattgcaacctcaaatcaaattcctccaactacggaggatggtaccaggcagaagacgcagggttcatgtacggaagtcgtaccacttctctcgagctcagtctgaactcctacggatgcaggtcccccgactacgccaattaa

SEQ ID NO: 275 - protein, 302 aa, Medicago truncatula
MEQPQQQQQPQTQQHSPNNGIMGSRQSSTRWTPTTDQIRILKDLYYNNGIRSPSAEQIQRISARLRQYGKIEGKNVFYWFQNHKARERQKKRFTSDVNVVPIIQRAPNNNTIISAANWKPDHHEQQQNINVHTNHSTYNISSAGLSSASCSSAEMVTVGQIGNYGYGSVPMEKSFRECTISAGCSSSQVGSTINPHIGWIGHHVDPYSSAYANLFEKIRPNEEIMEEYDQGQENGSPEIETLPLFPMHGEDIHGGYCNLKSNSSNYGGWYQAEDAGFMYGSRTTSLELSLNSYGCRSPDYAN

SEQ ID NO: 276 - DNA, 924 bp, Petunia x hybrida
atggaaacagcacagcaccagcagaacaaccaacagcactacctccaccaacacctctccatcggacaaggaacaaacatcgaggacggcagtaacaagaacaactcctccaacttcatgtgcaggcaaaatagtacccgctggacaccaaccactgaccagatcaggatattaaaggacctctactacaacaacggagtcagatcacctaccgctgaacagatccagagaatctccgccaagctcaggcagtacggcaagatcgagggcaagaacgtcttctactggttccagaaccataaagcccgcgagagacaaaagaagcgcctcatcgccgcagccaccaccgataacactaacctcccaatgcagatgcagttccagagaggagtctggagatcctctgcagacgaccccatccaccacaagtatactaatccaggagtgcactgcccttcagcttcttcccacggagttctcgcagtcggacagaacggcaatcacggatacggagccttggcaatggaaaaatccttccgcgactgctccatcagtccaggcagttccatgtcacaccaccaccaccaaaacttcgcttgggcaggagtcgatccttattcctcaaccacaacctaccctttcctcgagaagaccaagcacttcgagaatgaaaccctcgaagctgatgaagagcagcaagaggaggaccaggagaactactactaccaaaggaccacctctgccatcgaaaccctgcctctcttccctatgcacgaggagaacatctcctccttctgcaacctcaagcaccaggagtcatccggaggattctacaccgagtggtacagagcagacgacaacctcgcagcagccagagcttccctcgagctctccttgaactccttcatcggcaactcctcctag

SEQ ID NO: 277 - protein, 307 aa, Petunia x hybrida
METAQHQQNNQQHYLHQHLSIGQGTNIEDGSNKNNSSNFMCRQNSTRWTPTTDQIRILKDLYYNNGVRSPTAEQIQRISAKLRQYGKIEGKNVFYWFQNHKARERQKKRLIAAATTDNTNLPMQMQFQRGVWRSSADDPIHHKYTNPGVHCPSASSHGVLAVGQNGNHGYGALAMEKSFRDCSISPGSSMSHHHHQNFAWAGVDPYSSTTTYPFLEKTKHFENETLEADEEQQEEDQENYYYQRTTSAIETLPLFPMHEENISSFCNLKHQESSGGFYTEWYRADDNLAAARASLELSLNSFIGNSS

SEQ ID NO: 278 - DNA, 864 bp, Phaseolus vulgaris
atggaaccacagcagccccagggcagtcaaccaaacgaggacggtggaagtgggaaaggcggatttctctccagacagtcctccactaggtggactccaaccactgaccagatcagaatactcaaagacctctactacaacaacggaatcagatccccttccgcagaacagatccaaaggatctccgctaggctcagacagtacgggaagatcgagggcaagaacgtcttctactggttccaaaaccacaaggccagggagagacagaagaagaggttcacctccgacaacgtccccatgcaaagacctgcaccaacaaatgctgcacctccttggaaacccgaccaagaccccattcacaccaagtactccaacatctcctccacaggaatctccagtgcatcctcctcctcagtcgagatgatcaccgtcggacaaatggggaactacgggtacggaagtgtgccaatggaaaagtccttcagagactgctccatatccgccggaggatcttccggtcatgttggaataaaccacaacctcggctgggtgggagtcgatccttactcttctgcatacgccaacttcttcgataaaataagaccaaacgaagagaccctcgaggaagaagaagaggaggaggaggaggaagaagaagaggacggaggagcagaaattgagaccctccccctgttcccaatgcacggagaggacattcacggctactgcaacctcaagtccaacagttacaactacgacggcaacggctggtatcacagtgaggatggcttcaaaaacggcagtagggcctccctcgagctctccctcaactcttacaccagaagatcccccgacttcgcatag

SEQ ID NO: 279 - protein, 287 aa, Phaseolus vulgaris
MEPQQPQGSQPNEDGGSGKGGFLSRQSSTRWTPTTDQIRILKDLYYNNGIRSPSAEQIQRISARLRQYGKIEGKNVFYWFQNHKARERQKKRFTSDNVPMQRPAPTNAAPPWKPDQDPIHTKYSNISSTGISSASSSSVEMITVGQMGNYGYGSVPMEKSFRDCSISAGGSSGHVGINHNLGWVGVDPYSSAYANFFDKIRPNEETLEEEEEEEEEEEEEDGGAEIETLPLFPMHGEDIHGYCNLKSNSYNYDGNGWYHSEDGFKNGSRASLELSLNSYTRRSPDFA

SEQ ID NO: 280 - DNA, 963 bp, Zea mays
atggcggccaacgtgggcgcgggcaggagtgctggcggcggcggagccggcactggcactggcactgctgctggcagcggcggcgtgtcgacggccgtgtgccgccctagcggctcgcggtggacgccgacgccggagcagatcaggatcctcaaggagctctactacggctgcggcatccggtcgcccaactcggagcagatccagcgcatcaccgccatgctgcggcagcacggcaagatcgagggcaagaacgtcttctactggttccagaaccacaaggcccgcgagcgccagaagcgccgcctcaccaacctcgacgtcaacgtgcccgtcgccgccgacgacagcgcccaccgccttggcgtcctctcgttgtcgccttcttcaggttgttcaggcgcggcgcctccgtcgcccaccctcggcttctacgccggcggcaatggctccgctgtgatgctggacacgagttccgattggggcagcgctgctgccatggccactgaggcatgcttcatgcaggactacatgggcgtgatgggcggcgcgtcaccgtgggcatgctcctcctcgtcgtcggaggacccgatggcggcgctggcgctggcgccgaaggtgacccgggcgcccgagacgctccctctcttcccgaccggcggcggcggagacgataggcagcccccgcggccgcggcagtctgtcccagcaggcgaggccatccgcggcggcagcagcagcagcagctaccttccgttctggggtgccgcgcccaccccaactggcagtgccacttccgttgcgatccagcagcaacaccagctgatgcagatgcaagagcagtacagcttttacagcaacgcccagctgctgcccggcaccggcagccaggatgcagcagcaacatccctggagctgagcctcagctcctggtgctccccttaccctgcagggaccatgtga

SEQ ID NO: 281 - protein, 320 aa, Zea mays
MAANVGAGRSAGGGGAGTGTGTAAGSGGVSTAVCRPSGSRWTPTPEQIRILKELYYGCGIRSPNSEQIQRITAMLRQHGKIEGKNVFYWFQNHKARERQKRRLTNLDVNVPVAADDSAHRLGVLSLSPSSGCSGAAPPSPTLGFYAGGNGSAVMLDTSSDWGSAAAMATEACFMQDYMGVMGGASPWACSSSSSEDPMAALALAPKVTRAPETLPLFPTGGGGDDRQPPRPRQSVPAGEAIRGGSSSSSYLPFWGAAPTPTGSATSVAIQQQHQLMQMQEQYSFYSNAQLLPGTGSQDAAATSLELSLSSWCSPYPAGTM

SEQ ID NO: 282 - DNA, 978 bp, Zea mays
atggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccttcaggcgcggcgcctccctcgcccaccctcggcttctacgccgccggcaatggcggcggatcggctgggctgctggacacgagttccgactggggcagcagcggcgctgccatggccaccgagacatgcttcctgcaggactacatgggcgtgacggacacgggcagctcgtcgcagtggccatgcttctcgtcgtcggacacgataatggcggcggcggcggccgcggcgcgggtggcgacgacgcgggcgcccgagacactccctctcttcccgacctgcggcgacgacgacgacgacgacagccagcccccgccgcggccgcggcacgcagtcccagtcccggcaggcgagaccatccgcggcggcggcggcagcagcagcagctacttgccgttctggggtgccggtgccgcgtccacaactgccggcgccacttcttccgttgcgatccagcagcaacaccagctgcaggagcagtacagcttttacagcaacagcacccagctggccggcaccggcagccaagacgtatcggcttcagcggccgccctggagctgagcctcagctcatggtgctccccttaccctgctgcagggagcatgtga

SEQ ID NO: 283 - protein, 325 aa, Zea mays
MAANAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPSGAAPPSPTLGFYAAGNGGGSAGLLDTSSDWGSSGAAMATETCFLQDYMGVTDTGSSSQWPCFSSSDTIMAAAAAAARVATTRAPETLPLFPTCGDDDDDDSQPPPRPRHAVPVPAGETIRGGGGSSSSYLPFWGAGAASTTAGATSSVAIQQQHQLQEQYSFYSNSTQLAGTGSQDVSASAAALELSLSSWCSPYPAAGSM

SEQ ID NO: 284 - DNA, 666 bp, Zea mays
atggaggcgctgagcgggcgggtaggcgtcaagtgcgggcggtggaaccctacggcggagcaggtgaaggtcctgacggagctcttccgcgcggggctgcggacgcccagcacggagcagatccagcgcatctccacccacctcagcgccttcggcaaggtggagagcaagaacgtcttctactggttccagaaccacaaggcccgcgagcgccaccaccacaagaagcgacgccgcggcgcgtcgtcgtcctcccccgacagcggcagcggcaggggaagcaacaacgaggaagacggccgtggtgccgcctcgcagtcgcacgacgccgacgccgacgccgacctcgtgctgcaaccgccagagagcaagcgggaggccagaagctatggccaccatcaccggctcgtgacatgctacgtcagggacgtggtggagcagcaggaggcgtcgccgtcgtgggagcggccgacgagggaggtggagacgctagagctcttccccctcaagtcgtacggcgacctcgaggcggcggagaaggtccggtcgtacgtcagaggaagcggcgccaccagcgagcagtgcagggagttgtccttcttcgacgtcgtctccgccggccgggatccgccgctcgagctcaggctctgcagcttcggtccctag

SEQ ID NO: 285 - protein, 221 aa, Zea mays
MEALSGRVGVKCGRWNPTAEQVKVLTELFRAGLRTPSTEQIQRISTHLSAFGKVESKNVFYWFQNHKARERHHHKKRRRGASSSSPDSGSGRGSNNEEDGRGAASQSHDADADADLVLQPPESKREARSYGHHHRLVTCYVRDVVEQQEASPSWERPTREVETLELFPLKSYGDLEAAEKVRSYVRGSGATSEQCRELSFFDVVSAGRDPPLELRLCSFGP

SEQ ID NO: 286 - DNA, 975 bp, Zea mays
atggagacgccacagcagcaatccgccgccgccgccgccgccgccgcccacgggcaggacgacggcgggtcgccgccgatgtcgccggcctccgccgcggcggcggcgctggcgaacgcgcggtggaacccgaccaaggagcaggtggccgtgctggaggggctgtacgagcacggcctgcgcacccccagcgcggagcagatacagcagatcacgggcaggctgcgggagcacggcgccatcgagggcaagaacgtcttctactggttccagaaccacaaggcccgccagcgccagaggcagaagcaggacagcttcgcctacttcagcaggctcctccgccggcccccgccgctgcccgtgctctccatgccccccgcgccaccgtaccatcacgcccgcgtcccggcgccgcccgcgataccgatgccgatggcgccgccgccgcccgctgcatgcaacgacaacggcggcgcgcgtgtgatctacaggaacccattctacgtggctgcgccgcaggcgccccctgcaaatgccgcctactactacccacagccacagcagcagcagcagcagcaggtgacagtcatgtaccagtacccgagaatggaggtagccggccaggacaagatgatgaccagggccgcggcgcaccagcagcagcagcacaacggcgccgggcaacaaccgggacgcgccggccaccccagccgcgagacgctccagctgttcccgctccagcccaccttcgtgctgcggcacgacaaggggcgcgccgccaacggcagtaataacgactccctgacgtcgacgtcgacggcgactgcgacagcgacagcgacagcgacagcgtccgcttccatctccgaggactcggatggcctggagagcggcagctccggcaagggcgtcgaggaggcgcccgcgctgccgttctatgacttcttcgggctccagtcctccggaggccgctga

SEQ ID NO: 287 - protein, 324 aa, Zea mays
METPQQQSAAAAAAAAHGQDDGGSPPMSPASAAAAALANARWNPTKEQVAVLEGLYEHGLRTPSAEQIQQITGRLREHGAIEGKNVFYWFQNHKARQRQRQKQDSFAYFSRLLRRPPPLPVLSMPPAPPYHHARVPAPPAIPMPMAPPPPAACNDNGGARVIYRNPFYVAAPQAPPANAAYYYPQPQQQQQQQVTVMYQYPRMEVAGQDKMMTRAAAHQQQQHNGAGQQPGRAGHPSRETLQLFPLQPTFVLRHDKGRAANGSNNDSLTSTSTATATATATATASASISEDSDGLESGSSGKGVEEAPALPFYDFFGLQSSGGR

SEQ ID NO: 288 - DNA, 543 bp, Zea mays
atgcatggtgtacgtacgtatctcttaattttcattgtatcaaagctgcaggtgcaagtgccgccgacgacgacgacggtgggtggcacgacgcggtggaacccgtcgccggaccagataagggtgctggagatgctgtaccgcggggggatgcgcacgcccaactcgttccagatcgagcagatcacggaggagctcggcaagtacggccggatcgagggcaagaacgtcttctactggttccagaaccacaaggcccgcgagcgccagaagcagaagcgagctgccctcctcaccctcagcaccaccaccactgcttccacgctgctaccaccagctgctgaaaccaaggagggagtggagacgaaaaaagaagaagcgtgtgaagatgcatcgagccgcaagcggaggtgcagggcctgggaagatgtcgtcgtccatggtggcggcgacgatgccggtacggaggtagctgacgactactacaccgacgacgatgtgaccctggagctcttcccgctgcgtcctgatcaggggaaataa

SEQ ID NO: 289 - protein, 180 aa, Zea mays
MHGVRTYLLIFIVSKLQVQVPPTTTTVGGTTRWNPSPDQIRVLEMLYRGGMRTPNSFQIEQITEELGKYGRIEGKNVFYWFQNHKARERQKQKRAALLTLSTTTTASTLLPPAAETKEGVETKKEEACEDASSRKRRCRAWEDVVVHGGGDDAGTEVADDYYTDDDVTLELFPLRPDQGK

SEQ ID NO: 290 - DNA, 708 bp, Zea mays
atggacacggaggcgccgagcgggcgggtgggcgtcaagtgcgggcggtggaacccgacgccggagcaggtgaaggtcctgacggagctcttccgcgcggggctgcggacgcccagcacggaccagatccagcgcatctccgcccacctcggcgccttcggcaaggtggagagcaagaacgtcttctactggttccagaaccacaaggcccgcgagcgccaccaccacaagaagaagaagcgccgccgacgcggcgcggcaatggcatcgtcgtcctcccccgacagcggcagcggcagcgggagcagcgaggaagacggccgtgttgccgccgccgccgacgccgacctcgtgctgcaaccatcgccgggaagaagcaaaagcaaacgggaggccagaagaagctacggcggcggccaccatcgccggctcgttacatgtaagcagctagcgcacacacatcgctacgtcagggacgttgtggagcagcaggaggaggacacgtgggagcggccgacgagggaggcggtggagactctggagctcttccccctcaagtcgtacgtcgacctcgaggcggagaaggtccggcggtacgtcgtcagggccggcgccagcgagcagtgcagggacttctccttcttcgacgtgtccggcggtcgggatccgccgcttcttgagcttaggctctgcagcttcggtccctag

SEQ ID NO: 291 - protein, 235 aa, Zea mays
MDTEAPSGRVGVKCGRWNPTPEQVKVLTELFRAGLRTPSTDQIQRISAHLGAFGKVESKNVFYWFQNHKARERHHHKKKKRRRRGAAMASSSSPDSGSGSGSSEEDGRVAAAADADLVLQPSPGRSKSKREARRSYGGGHHRRLVTCKQLAHTHRYVRDVVEQQEEDTWERPTREAVETLELFPLKSYVDLEAEKVRRYVVRAGASEQCRDFSFFDVSGGRDPPLLELRLCSFGP

SEQ ID NO: 292 - DNA, 1545 bp, Zea mays
atggcctcctccttcaacaacaaaaccagtcactggccgagcatgtttaggtccaagcacgccgctgagccgtggcaggcgcagcctgacatcagcagctcgccgccgtcgctcctctcaggtggcggctctagcagcaccaccaccatcggccgctgcctcaagcaccccctctcaggttactcaggtggcgaggagcggaccccggatccgaagccccggtggaaccccaggccggagcagatccggattctggaggccatcttcaactccggcatggtcaacccgccgcgcgacgagatcccccgcatccgcatgcgcctgcaggagtacggccaggtcggcgacgccaacgtcttctactggttccagaaccgcaagtcccgctccaagaacaagcagcgcaccggacagctggggctgggccttgcgcgcgcgccgggttgcggggccgctgcgccgcccgtcacgccgcagcccttgatccagaaccaattccaggtgctcgcctcgcccgcgcaggcgccagcttcctcgtcctcgtcctcctccgaccgctcctctgggtccagcaagccggcgccgcagccgatgtccgcgacggcagcggccatgaactttccagggccgctcggcgcggcgtgtgcgcagatgtactaccaagcccaccccgtggcgccggtctcggcgttgccagcgcacaaggtgcaggaccctgtagcctccgacgagcccgtcttccagccgtggccacaaggctacttcctgtcggctgccgaggtcgccagcattctcgggggccagtacaggcacgacgtgcccgtgcagcagcagccaccggcgacgttgcctgcgggagcgttcttggggctgtacaacgaggtgacagagccgactgtcactggtcacaggacatgcgcctggggcccggcggggctcgggcagttctggcccgtgggcggcgctgatcaccatcagcaccacaagcacaataccaccgcggcgaccaacaccgtagcaagggacgcggcgcacgagcacgccacgacgctggggttgctgcagtacggcttcgaagctagcgcggccatggagacggcttccgcggcggtgccccttgctgcgtcgccgggaaccgctgcgagcgtggcgacggctgggctcacatctttgcctgcaagtactaatgctgttgtcgtcaactatgatctgctgcaaggactggcagtgcccgggtccgggtccggggccgtcggtgtcagcaccggcggtgcaccgcctgtcgccgttgccgcggcgcccacggcagcgcaggagggcgtcgtcgtagcactgtgcatcacggacagcgtcacgggcaagagcgtggcacacaacgtcgcggctgccaggctcgacgtgagggcgcagttcggcgaggcggccgttctgctccgcgccgtcggcgaccgcggcgggctcgacctcgtgcccgtccccgtcgacgcgttgggctgcacagtggagccgctccagcacggtgccttttactacgtgctggtataa

SEQ ID NO: 293 - protein, 514 aa, Zea mays
MASSFNNKTSHWPSMFRSKHAAEPWQAQPDISSSPPSLLSGGGSSSTTTIGRCLKHPLSGYSGGEERTPDPKPRWNPRPEQIRILEAIFNSGMVNPPRDEIPRIRMRLQEYGQVGDANVFYWFQNRKSRSKNKQRTGQLGLGLARAPGCGAAAPPVTPQPLIQNQFQVLASPAQAPASSSSSSSDRSSGSSKPAPQPMSATAAAMNFPGPLGAACAQMYYQAHPVAPVSALPAHKVQDPVASDEPVFQPWPQGYFLSAAEVASILGGQYRHDVPVQQQPPATLPAGAFLGLYNEVTEPTVTGHRTCAWGPAGLGQFWPVGGADHHQHHKHNTTAATNTVARDAAHEHATTLGLLQYGFEASAAMETASAAVPLAASPGTAASVATAGLTSLPASTNAVVVNYDLLQGLAVPGSGSGAVGVSTGGAPPVAVAAAPTAAQEGVVVALCITDSVTGKSVAHNVAAARLDVRAQFGEAAVLLRAVGDRGGLDLVPVPVDALGCTVEPLQHGAFYYVLV

SEQ ID NO: 294 - DNA, 663 bp, Gnetum gnemon
atggaagaaaacagcaacagcagcagaagcagcaacagcggcgcacgttggaatccgacgccggagcagctgagcattctgaaagagctgtatcatggccgcggaatcaggtcgcccagcgccgaacagatccaccatatctcatggaaactcagctcctacggcaaaatcgagggcaagaacgtcttctactggttccagaaccataaggcccgccagcgtcaaaaagagcgtctcggttccgtcatgcctgcttctgcttcttcttcttcttttgcatctccttctcagggagctgtcggcattcgaaggggaagtacggtgctatgtcttaaggaaacttcagcttcatcttcatcttattcttctgttccgcgttcggtatcagctgtgcgccagtgtgctgcatctcgtgactgtggcttgcaccatgatctgacaactctggagctgtttcccctgcaccgtgaaagtagaatagacgctggggaggaagacgaggagcaacaggaggtggtggtgctagataataataataacacctggacaaggcaccaaaatgtaaatgtgaatcatgcaaataatgacgatgagccacagcatggtcatgggcagattgatattgatgtagggcttcgtctttgcctcggtggatttcgctga

SEQ ID NO: 295 - protein, 220 aa, Gnetum gnemon
MEENSNSSRSSNSGARWNPTPEQLSILKELYHGRGIRSPSAEQIHHISWKLSSYGKIEGKNVFYWFQNHKARQRQKERLGSVMPASASSSSFASPSQGAVGIRRGSTVLCLKETSASSSSYSSVPRSVSAVRQCAASRDCGLHHDLTTLELFPLHRESRIDAGEEDEEQQEVVVLDNNNNTWTRHQNVNVNHANNDDEPQHGHGQIDIDVGLRLCLGGFR

SEQ ID NO: 296 - DNA, 987 bp, Malus domestica
atggaccctcaacagaacccaaatgaagtacaagaaggaggcaacaggcaggggggtggaatcatgtgcaggcaaagcagtacgcggtggacacccacaactgatcagataaaaatcttgaaggacctttactacaacaatggcattaggtcacccagcgctgagcagattcagaggatctctgctaagctgcgacagttcggcaagatcgaaggcaagaacgttttctattggtttcagaaccacaaagctcgtgagaggcagaagaaaagattcacttcttcttctgctcctgatcaccatcatcatgcagcaccaccagtgccagctgtaccaccagaatccaataatatcaggcaaagatcatcaggggttgggattgatattaatgcaactgctgctgctgcttatgaacaagcacccattaatcaccaccgcaagtattccaacatttctgctccaccagccgggttttcttctgcatcttcttcttcagttggtgtgaatgtttctgttggggcacagatgggaaactatgggtatggatccattgctatggagaagagctttagggagtgctcaatatcatctggaggaagtactagcactggtcatgtgggtggatctaattataatacttttaatcacaactatggatcatgggttggtgttgatccatattcctcgccctacactatctttgacaagaaatcctcatcaaaaccagtgtttggtgaccaggaaaatatgacggaagaagaatactacaatctgcaagcttcccaagagattgagactctcccactcttccccatgcacggtgaagacattcatggctttggcaacatcaagtcatcctctatggatggctactactccggctggtacaggtccgatggcggcaacgatggtggctctcgcacttcccttgagcttagcctcaattcctacggtcacatgacccatgattacttcagatcatattga

SEQ ID NO: 297 - protein, 328 aa, Malus domestica
MDPQQNPNEVQEGGNRQGGGIMCRQSSTRWTPTTDQIKILKDLYYNNGIRSPSAEQIQRISAKLRQFGKIEGKNVFYWFQNHKARERQKKRFTSSSAPDHHHHAAPPVPAVPPESNNIRQRSSGVGIDINATAAAAYEQAPINHHRKYSNISAPPAGFSSASSSSVGVNVSVGAQMGNYGYGSIAMEKSFRECSISSGGSTSTGHVGGSNYNTFNHNYGSWVGVDPYSSPYTIFDKKSSSKPVFGDQENMTEEEYYNLQASQEIETLPLFPMHGEDIHGFGNIKSSSMDGYYSGWYRSDGGNDGGSRTSLELSLNSYGHMTHDYFRSY

SEQ ID NO: 298 - DNA, 867 bp, Manihot esculenta
atggaacctcaacaacaacagcagcagcagcaaaaccaacaacaaccaaacgatgacaatagcagcggtgccaaaggaaactttctttgcaggcaaagcagtactaggtggactcccacaactgaccaaataagaatattgaaggacctttactacaacagtggagttaggtccccaagtgcagagcagattcagaggatatctgctaggcttagacagtacggtaagattgaaggcaagaatgtcttttattggtttcagaaccataaagctcgtgagaggcagaagaaaaggttcaccactgatgtccccatgcaacaaagaactgtttcgaatgcttctagttggaagcctgaagactattccttccacaacaaataccccaacattgctcctgggttttcttctgcatctccatcctcagctgctgggcttcctgttggacagatgggaaactatgggtatggatctgtaactatggagaagagttttagggactgctcaatatcagctactgccaacggtggtgttggtggatccatgagccccaactgtgggtgggttggcattgatccctactgttcatcctactctctctttgacaagcaaaaatcaactaatgaaaccctagaagatgaagaacaagatcaagatcaagaagaggaagcaactccagggattgaaaccctccctctcttccctacccagagagaagacatcaatggcttctgcaacatgaagcaccaccccatctgctactccgaaaactactgctatggctctgacgatggaaacaacgcttcgcgtacttccctcgaacttagcctcaactcttacagcaatgggcaggcacgggattccatctaa

SEQ ID NO: 299 - protein, 288 aa, Manihot esculenta
MEPQQQQQQQQNQQQPNDDNSSGAKGNFLCRQSSTRWTPTTDQIRILKDLYYNSGVRSPSAEQIQRISARLRQYGKIEGKNVFYWFQNHKARERQKKRFTTDVPMQQRTVSNASSWKPEDYSFHNKYPNIAPGFSSASPSSAAGLPVGQMGNYGYGSVTMEKSFRDCSISATANGGVGGSMSPNCGWVGIDPYCSSYSLFDKQKSTNETLEDEEQDQDQEEEATPGIETLPLFPTQREDINGFCNMKHHPICYSENYCYGSDDGNNASRTSLELSLNSYSNGQARDSI

SEQ ID NO: 300 - DNA, 960 bp, Kalanchoe fedtschenkoi
atggaagctcaacagcaacagcataatacaatgatgggtgatgaccttggcggtggcaagttggcagccaccagcttcacaagagcgcaaaccaacagcagcaacaaccacagcctagttaataacaacggcggcagaagaagcagcacgaggtggacaccaacaacagaccagataagaatactcaaagatctttactacaacaatggagtgaggtctcccacggtggagcagattcagaggatctctgctaggttgagacagtacggtaagatcgagggcaaaaatgtcttctactggtttcagaaccaaaaggctcgtgaaagacagaagaggaggttcaacacaaccagcaccaccaacaacaacactgctcccgctcctctccctccatcttctactgtttgtaaaccttcttcgctagactcatccactccacacattcacactgcagcagcagctgctgctgctgcctccaaatactcagacatcaacaacaaccaaaaccttatctacccagctgggcacaatcagatgtcaggtttcggatatgctgcctccgtaacaatggagaagagcttcagagattgttctatatcgacgggcgggtcatctttcggttgggctaaaggaggaatgacagatcaccatctgtctcgtcatccctacccgcacacttcaccctatgcaatctacaaccagcggaaatcaataaacagtgatgagtatcacgagctactggcatcatcaacttcggatcatcatgaacatggggataatcggggtccggagattgaaaccctgccactatttcccatgcacggcgaggacatcaactacggcttctgccaccttaattcagccgagactgatggctggttcaatcgcgatgtgggtagtggctctcgtgcgtccctcgagctcagtctcaactcttacgcaggaatggaccacacctag

SEQ ID NO: 301 - protein, 319 aa, Kalanchoe fedtschenkoi
MEAQQQQHNTMMGDDLGGGKLAATSFTRAQTNSSNNHSLVNNNGGRRSSTRWTPTTDQIRILKDLYYNNGVRSPTVEQIQRISARLRQYGKIEGKNVFYWFQNQKARERQKRRFNTTSTTNNNTAPAPLPPSSTVCKPSSLDSSTPHIHTAAAAAAAASKYSDINNNQNLIYPAGHNQMSGFGYAASVTMEKSFRDCSISTGGSSFGWAKGGMTDHHLSRHPYPHTSPYAIYNQRKSINSDEYHELLASSTSDHHEHGDNRGPEIETLPLFPMHGEDINYGFCHLNSAETDGWFNRDVGSGSRASLELSLNSYAGMDHT

SEQ ID NO: 302 - DNA, 840 bp, Gossypium hirsutum
atggaaccccagcaacagcaacagcaaaaccaacaagctccaaatgaggattgtggtggtggcagtggcaaaggaagctttctttgcaggcaaagtagtacacggtggactcctaccactgaccagattagaatattgaaggacctttactacaacaatggagttaggtccccgagtgctgatcagattcaaaggatctctgctagacttagacagtacggaaaaatcgaaggcaagaatgtcttttattggtttcagaaccacaaggctcgtgagaggcagaagaaaaggttcaccaccacgactaatcatcatgtccccatgcaaagccctaccactgctgcaaataacaagtatcccaacataactcctggttattctcctacatctctttcttcaactggtgctcttactgttgggcagataggaaactatggctatgggtctataactatggaaaagagttttagggattgctcaatatcagcatgtggtagtagtacaagtgtaggcgaatccctgagtcacaactttggatgggttgggttcgatcctacttattcttcgtcctacacattctttgagcacaaaaaattcatggaagagagacaaaaagatgaagatgatgcagaagaagaagctgctgctccacaaattgagaccctccctctctttcccatgcacagtgaagacgctaatggtttttgcagtaatattaggcccagactagacagctgctactctgggtggtacaggtctgaagatggctacactggttctcgtgcctcacttgagctcagcctcaacccatatgcaggcagaccgcaagattctatctga

SEQ ID NO: 303 - protein, 279 aa, Gossypium hirsutum
MEPQQQQQQNQQAPNEDCGGGSGKGSFLCRQSSTRWTPTTDQIRILKDLYYNNGVRSPSADQIQRISARLRQYGKIEGKNVFYWFQNHKARERQKKRFTTTTNHHVPMQSPTTAANNKYPNITPGYSPTSLSSTGALTVGQIGNYGYGSITMEKSFRDCSISACGSSTSVGESLSHNFGWVGFDPTYSSSYTFFEHKKFMEERQKDEDDAEEEAAAPQIETLPLFPMHSEDANGFCSNIRPRLDSCYSGWYRSEDGYTGSRASLELSLNPYAGRPQDSI

SEQ ID NO: 304 - DNA, 969 bp, Zostera marina
atggaacatcatcatcagcagcagttccacggtggccagccgcagctgatgagtgaaaatgaagagatgaacaacaatgggagcgggggtgggagtagtaagagcagttttctttgcagacagtcgagcacaaggtggatacccactactgatcagataaggatactgaaggatctatactacaacagtggactgagatccccaaacgccgatcagatccaaagaatatccgccagactgaggcagtacggaaagatcgagggtaagaatgttttctactggtttcaaaatcacaaagcccgagagaggcagaagaagagactcaccgtcgatattgctgcagcggcaactaccaacaaattctccaacaacactaatatgtcttcttcttcttctccctcagggatttctcctgcttctcatgcagtgtatgcaggattagggcagatggggagcaatggcggtggatcagtcgtgatggagagaacttcttacatggagtgttccttgccaggtgggatgccgatgcccgtacctgaacccaatgtgggagtcggagtgggatgggtgagtgttgaaacaggagctactactatgcaacaattctactaccatcaacagagaccaaccacaccctttcctgctcctcatcatcaccaccattactacgacgacggttactattccaataataacaaacttcaagcccatcacctacatatacgcgaggaaaatcaacatccagaagatgacgacgaagaagaagaagaagaagaagaagatgaagagatagaaacacttccattgttcccaatccactcacaggagacacagtcttacttcctggaccaacaacatgcaatccacaatcaagaaagcaataacatggaaacctctttggagctcaccctaaactcctactatgctgcttccagtagcagtactccacatggatcagagcatgattaa

SEQ ID NO: 305 - protein, 322 aa, Zostera marina
MEHHHQQQFHGGQPQLMSENEEMNNNGSGGGSSKSSFLCRQSSTRWIPTTDQIRILKDLYYNSGLRSPNADQIQRISARLRQYGKIEGKNVFYWFQNHKARERQKKRLTVDIAAAATTNKFSNNTNMSSSSSPSGISPASHAVYAGLGQMGSNGGGSVVMERTSYMECSLPGGMPMPVPEPNVGVGVGWVSVETGATTMQQFYYHQQRPTTPFPAPHHHHHYYDDGYYSNNNKLQAHHLHIREENQHPEDDDEEEEEEEEDEEIETLPLFPIHSQETQSYFLDQQHAIHNQESNNMETSLELTLNSYYAASSSSTPHGSEHD

SEQ ID NO: 306 - DNA, 693 bp, Amborella trichopoda
atggatcattctgataactgcccaggtaacaacaacaactctggttctggttctggttctggaaccaagtctggttacatgtgcagacaatctaactctagatggatcccaaccgctgaacaaatcagaatccttagagaactttactactctaacggtgttagatctccaaccgctgaacaaatccaaagaatctctgctagacttagacaatacggtaagatcgaaggtaagaacgttttttactggtttcaaaaccataaggctagagaaagacaaaagaagagacttaccgttgatcttgctgttcaaagagctgctgctacctctggtggtcttccaccaggtgttcttaacgtttctcatatcgctggttctacctgcggttctgttcttatggaatcttctcttatggattgctgctctacctctgctcttgaaaaccataacggtagaaaggaaagagctaacggtgatatgatcgttgaaagagaaagatctgctccaggtaaggaaacccttcaactttttccaatgcatcattctccacaaaacgatgataccatcgctgatgattacttttttaacgatgaagaagaaaagccagtttgcatggcttctcttgaacttacccttaactcttttgatagagtttaccatccagattctgattttagatctcattcttcttaa

SEQ ID NO: 307 - protein, 230 aa, Amborella trichopoda
MDHSDNCPGNNNNSGSGSGSGTKSGYMCRQSNSRWIPTAEQIRILRELYYSNGVRSPTAEQIQRISARLRQYGKIEGKNVFYWFQNHKARERQKKRLTVDLAVQRAAATSGGLPPGVLNVSHIAGSTCGSVLMESSLMDCCSTSALENHNGRKERANGDMIVERERSAPGKETLQLFPMHHSPQNDDTIADDYFFNDEEEKPVCMASLELTLNSFDRVYHPDSDFRSHSS

SEQ ID NO: 308 - DNA, 834 bp, Aquilegia coerulea
atggaacctcaacaagatcccaataaccaacaacaacaacttcaacaacaacaacatgaagaaaacagcagtggaagtagtagcaaaagcagttttctttgcaggcaaactagtacaaggtggacacccacaagtgatcagataagaatcttgaaagacctttactacaacaatggagttaggtctccaagtgcagagcaaatacagagaatctcagcaaggttaaggcagtacggtaagattgaaggcaagaatgttttctattggtttcagaaccacaaagctcgtgagagacaaaagaagagattcacaaatgatacaacaaccatgtccatgcaaagagctactactgcaactggtcatgccaaatacattactacttctcctgggatttcatctccatcttctgctggtgtacttggtgttggacagatgggaagcaacatgggatatggatctgttgttatggagaagagttttagagactgttcaatatctcctgctgctggtggtggtggtggtggtggcagtaatatgggtggatatggatccatgaacaacaattttggttggattggtgcgggtgtcgagccatatccatttttcaacaagacaaagcatattcaaaaatatgaagaagaagatttctcccaaactgagattgaaacactaccactatttcccatgcatggtgaagacagtacaaggtttggttcatctggcaacccaaacccgaattggaactggtttcgaacaggagatgaaatgattggatctagaacatcattggagcttagcttgaattcttactctggcgggtcaattaataactga

SEQ ID NO: 309 - protein, 277 aa, Aquilegia coerulea
MEPQQDPNNQQQQLQQQQHEENSSGSSSKSSFLCRQTSTRWTPTSDQIRILKDLYYNNGVRSPSAEQIQRISARLRQYGKIEGKNVFYWFQNHKARERQKKRFTNDTTTMSMQRATTATGHAKYITTSPGISSPSSAGVLGVGQMGSNMGYGSVVMEKSFRDCSISPAAGGGGGGGSNMGGYGSMNNNFGWIGAGVEPYPFFNKTKHIQKYEEEDFSQTEIETLPLFPMHGEDSTRFGSSGNPNPNWNWFRTGDEMIGSRTSLELSLNSYSGGSINN

SEQ ID NO: 310 - DNA, 969 bp, Amaranthus hypochondriacus
atggagtttcaacaacaacaagatgaagagatgataaaccatgttgggaaaatgagcaacaacacaagtaacaataataataataataataactatttatgtagacaaagtagcacaagatggactccaacaacagaacaaataaagcttttaaaagatctttattatttacaaggaattagatctcctactgctgatcaaattcaaagcatttgtgctaggttacgtcgttatggaaaaattgaaggcaaaaatgttttttattggtttcaaaatcataaggctagggaaagacaaaaaaagaagcttactcctacttctcctaataataataataataataataataataatttcataagaaataataataataataataataatggaaatattaacacttttcatgctaaatatccttgttccttcaataataatcccggggtttcttgttcaagttcaccagcaggtgtgatttctggaggtgggcaattgatggggagttttgggtatggagctgtgactatggagactaaatttagggtaagaggaggtattcctattccaaatggagcaaatcaatggagtaactatttcaacccaaacaatccaacatcttactcaaatttctttattgacaaggtatcatcaaatgttgatcatcattatccatacattaaccatcatgatcatgatcatgatcatgatcatcatgatcatgatcattatggcccacaatcacctcatgagattcagactcttcctctctttcccatgcacaatgatcatcatgatctcgatctcgatctcgatctcgatcacgatcaagggttctacacctataagcctcaatcggacggctgtaattataccggaggatatcgatggtcatctaatgttaatggtggacatacttctcttgagcttagtcttaactcttatggatttggatgctattcacctaattaa

SEQ ID NO: 311 - protein, 322 aa, Amaranthus hypochondriacus
MEFQQQQDEEMINHVGKMSNNTSNNNNNNNNYLCRQSSTRWTPTTEQIKLLKDLYYLQGIRSPTADQIQSICARLRRYGKIEGKNVFYWFQNHKARERQKKKLTPTSPNNNNNNNNNNFIRNNNNNNNNGNINTFHAKYPCSFNNNPGVSCSSSPAGVISGGGQLMGSFGYGAVTMETKFRVRGGIPIPNGANQWSNYFNPNNPTSYSNFFIDKVSSNVDHHYPYINHHDHDHDHDHHDHDHYGPQSPHEIQTLPLFPMHNDHHDLDLDLDLDHDQGFYTYKPQSDGCNYTGGYRWSSNVNGGHTSLELSLNSYGFGCYSPN

SEQ ID NO: 312 - DNA, 924 bp, Cucumis sativus
atggaacatcctgccaaacaacaacaacaagaacaaggaattaatgatcaaggtggtgaaggtggtggtggaagcaatggaaaaggtgggtttttgtgtaggcaaagtagcagtcgatggactccaacaactgaccaaatacgaatattgaaagagctttattataacaatggtgttcgctccccaagcgctgatcaaattcagaggatctctgctaggcttagacagtacggtaaaatcgaaggcaaaaacgttttttattggtttcaaaaccataaggctcgtgaaagacagaagaaaagattcacttcaaattctacttctcctattactacctccaatactactacaactactactgattttaaaatttcttcaactaataataatattaactggaagtctgaagatcattcctcctcttctcataacaaatttcctccaggaataacaattgctttaattgattcttgtttttgcagctccttcttcttcggttatggtcgccgttggccatatgggaaattacggatatgggagtgttcaatatcgtcgggaggaaatagcagtgtcgtcggttaccggagccacaacatgggatcatggatcggtatcgatccgtattcttctccggcagctgccgcggcggggggatcagccaatgtgtttgaaaaaacaaaatatgttgaagaaagcatggaagatcacgaggagcaagagatcgaaactctcccccttttccccattcatggtgaccggaataatctcggtggtttctgcagcatgaagccggaatattcagagagctactacaccaccacttggtacgggcggtctgacgataatggagccgccggttctcgggcttcgctggaactcagcctcaactcttacgccaccatctcacctgatgatggaatgtga

SEQ ID NO: 313 - protein, 307 aa, Cucumis sativus
MEHPAKQQQQEQGINDQGGEGGGGSNGKGGFLCRQSSSRWTPTTDQIRILKELYYNNGVRSPSADQIQRISARLRQYGKIEGKNVFYWFQNHKARERQKKRFTSNSTSPITTSNTTTTTTDFKISSTNNNINWKSEDHSSSSHNKFPPGITIALIDSCFCSSFFFGYGRRWPYGKLRIWECSISSGGNSSVVGYRSHNMGSWIGIDPYSSPAAAAAGGSANVFEKTKYVEESMEDHEEQEIETLPLFPIHGDRNNLGGFCSMKPEYSESYYTTTWYGRSDDNGAAGSRASLELSLNSYATISPDDGM

SEQ ID NO: 314 - DNA, 840 bp, Pinus taeda
atggaatctgctgaaagaatcggttcttacgatgtttacagacaaccatcttctaccagatggaacccaacctctgaacaactttctatccttagagaactttactacaccaacggtatcagatctccaaccgttgatgaaatccatagaatctctatgaagctttctagatacggtaagatcgaaggtaagaacgttttttactggtttcaaaaccataaggctagacatagacaaaagaccagactttctgctatgaacgttggtaagccagctgcttctccagctctttctcaaaccaccagaaagcataagcaatgctacatcaccaccaacatcgttcttacccttaaccaacattgctacaccaagaccaacatggttcttcaaatcatctggtctcttggtcttggtaacaagtctcaaaccaccaagatggtttgggaaatcaagatcaccgcttttccaaccatccataccgaatctttttacgaaaacagaatggctggtgaaaactcttcttgcaaggaagctgcttgctgctctcttgaacaaatgtacgctgttaagcatcatgatgttatgaaggctatggaagaaaaccaacttcaagaaggtaagatcaacagacatgttgaaacccttgaactttttccaacccattgcgaagatagatctccagaaccatctgaaaagaagtcttgctgctggggttcttgcgaaaccaaggaaaaccataacaacaacccaccaggtggttacaagggtaagcaaagagattctgttcttgatctttgcctttctcttggtaacaagtcttgcggtcttcatgataactaa

SEQ ID NO: 315 - protein, 279 aa, Pinus taeda
MESAERIGSYDVYRQPSSTRWNPTSEQLSILRELYYTNGIRSPTVDEIHRISMKLSRYGKIEGKNVFYWFQNHKARHRQKTRLSAMNVGKPAASPALSQTTRKHKQCYITTNIVLTLNQHCYTKTNMVLQIIWSLGLGNKSQTTKMVWEIKITAFPTIHTESFYENRMAGENSSCKEAACCSLEQMYAVKHHDVMKAMEENQLQEGKINRHVETLELFPTHCEDRSPEPSEKKSCCWGSCETKENHNNNPPGGYKGKQRDSVLDLCLSLGNKSCGLHDN

SEQ ID NO: 316 - DNA, 927 bp, artificial sequence
  synthetic
atggctgctaacgccggcggcggaggagccggaggcggaagtggcagtggctcggttgccgcgcctgccgtatgtaggcctagtggttccagatggactccaacacctgagcagatacgcatgctcaaggaactttactacggttgtggtatccgctcgccttctagtgaacagattcaacgcataacagcgatgttgcgtcagcacggcaaaatcgaaggcaaaaacgtattttactggtttcaaaatcataaagcccgcgagcgtcaaaagaggagactcacgagtttggacgtgaacgtacctgctgccggagctgccgacgccaccacgtcccaacttggagttctgagtcttagctccccgccgccttccggagccgccccaccgagtcccactcttggattttatgccgctggaaatggaggaggttccgccgtgcttttggacacttcgtctgattggggttccagcggcgctgcaatggcgactgagacttgtttccttcaggactatatgggtgtcaccgatacgggaagttcatcacaatggcccaggttttcaagtagtgacactataatggctgcggctgccgcgagagcagctacgaccagggcacccgagacactgcctctcttcccaacttgcggtgacgacggcggctccggttcctcgagttatttgcctttctggggcgcggcctccacaacagcaggcgcgacaagttccgttgcaatccagcagcaacatcaacttcaggagcagtatagtttttactccaatagtaactccacccaactcgcgggcacgggcaaccaagacgtgagtgcgacagcagcggcagcagcggctttggagctgagtctgtcttcgtggtgctctccctatccagcggcaggttcaatgggacatcatcaccaccaccat

SEQ ID NO: 317 - protein, 309 aa, artificial sequence
  synthetic
MAANAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPPSGAAPPSPTLGFYAAGNGGGSAVLLDTSSDWGSSGAAMATETCFLQDYMGVTDTGSSSQWPRFSSSDTIMAAAAARAATTRAPETLPLFPTCGDDGGSGSSSYLPFWGAASTTAGATSSVAIQQQHQLQEQYSFYSNSNSTQLAGTGNQDVSATAAAAAALELSLSSWCSPYPAAGSMGHHHHHH

SEQ ID NO: 318 - DNA, 1221 bp, Zea mays
aattcgccctttgttgttgctcatcggtcgtcggactcttaatagccggctttaggatattgtccggggagatatcggtgtgatctttagaaccggccatttgatggcctgagttttagtagatctagacacatttccccaacggagtcgccaaaaagtgtgttggcgccgatccaggcgcgaaacactggagatggaccgtttggcggtgttctctgcggaggtgaggacggtccgcgacctggcgcagcagcgactctcctctacgtgtgtccggacggtccgcgtctggggctcggacggtccgcgatggcgcagagggtcttcttcttcgcagccgacctagatctcgcctcccgggagggaccccgtcggggaggagagattgtagggtgtgtcttggcgtcgacaggccacacaatacgcctctagtcgacgtagagccgaagagaggtgaaggattgaggtagaaggaggctaaacttgggctaaactagaactactgctaatgcataaggtaaaaacgagaagtggacttcatttgatcgattgtggaaggtttaatcgactgtagccctttatctatataaaggggaggtatggacccgttacaagcygtttcccgagctaatctcacggttttagttaataaatcctgcgagaaactcggaactctaactgattctactcatgcgcgaaccattcgtgccgccaccgctgcccgtccggctacgctcagttaaccctgtgttgtgcgctgtgatttggtggcatataaaaccacatttgcaataaaaatttgtagggatttaacataccaagtgctgcggaaaggaatcgttttcggaggacccaaaattaaagaggcagatgctagagctcgtccagctcagcgctgagcacctgtgttgtcttcctcgtccacgccggcggagatgaacggcaacaaaggcggaaaggccgagacgctgagctcaaggacgtgacaccgcgcgtacctcgcgttcagttggctcacacaacagcagctcgctcgccccaagctcccgcgtcctgatccgtaggtgagccatgcaaaggtcgccgcgcgccctgatccattgcacccttcaaagctcgaacctacaaatagcgtgcaccaggcatcctggccacacccacacagcaagccagcagagcagaaagcagccgcagccccagcccccacaagacgaggcaaca

SEQ ID NO: 319 - DNA, 111 bp, Zea mays
atggcgctagaagcagccaccgccccccgcgcactcctcgccgcgtgcctcgtcctgctggtcctcggcggcggcaccggcccgtcgtcggtgctgcgcggcgccggggcg

SEQ ID NO: 320 - protein, 37 aa, Zea mays
MALEAATAPRALLAACLVLLVLGGSTGPSSVLRGAGA

SEQ ID NO: 321 - DNA, 897 bp, Zea mays
caggcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatg

SEQ ID NO: 322 - protein, 299 aa, Zea mays
QAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPPSGAAPPSPTLGFYAAGNGGGSAVLLDTSSDWGSSGAAMATETCFLQDYMGVTDTGSSSQWPRFSSSDTIMAAAAARAATTRAPETLPLFPTCGDDGGSGSSSYLPFWGAASTTAGATSSVAIQQQHQLQEQYSFYSNSNSTQLAGTGNQDVSATAAAAAALELSLSSWCSPYPAAGSM

SEQ ID NO: 323 - DNA, 45 bp, artificial sequence
  synthetic
ggtggaggcggctccggtggcggaggctccggaggcggtggctcc

SEQ ID NO: 324 - protein, 15 aa, artificial sequence
  synthetic
GGGGSGGGGSGGGGS

SEQ ID NO: 325 - DNA, 720 bp, Aequorea coerulescens
atggtgagcaagggcgccgagctgttcaccggcatcgtgcccatcctgatcgagctgaatggcgatgtgaatggccacaagttcagcgtgagcggcgagggcgagggcgatgccacctacggcaagctgaccctgaagttcatctgcaccaccggcaagctgcctgtgccctggcccaccctggtgaccaccctgagctacggcgtgcagtgcttctcacgctaccccgatcacatgaagcagcacgacttcttcaagagcgccatgcctgagggctacatccaggagcgcaccatcttcttcgaggatgacggcaactacaagtcgcgcgccgaggtgaagttcgagggcgataccctggtgaatcgcatcgagctgaccggcaccgatttcaaggaggatggcaacatcctgggcaataagatggagtacaactacaacgcccacaatgtgtacatcatgaccgacaaggccaagaatggcatcaaggtgaacttcaagatccgccacaacatcgaggatggcagcgtgcagctggccgaccactaccagcagaatacccccatcggcgatggccctgtgctgctgcccgataaccactacctgtccacccagagcgccctgtccaaggaccccaacgagaagcgcgatcacatgatctacttcggcttcgtgaccgccgccgccatcacccacggcatggatgagctgtacaagtga

SEQ ID NO: 326 - protein, 239 aa, Aequorea coerulescens
MVSKGAELFTGIVPILIELNGDVNGHKFSVSGEGEGDATYGKLTLKFICTTGKLPVPWPTLVTTLSYGVQCFSRYPDHMKQHDFFKSAMPEGYIQERTIFFEDDGNYKSRAEVKFEGDTLVNRIELTGTDFKEDGNILGNKMEYNYNAHNVYIMTDKAKNGIKVNFKIRHNIEDGSVQLADHYQQNTPIGDGPVLLPDNHYLSTQSALSKDPNEKRDHMIYFGFVTAAAITHGMDELYK

SEQ ID NO: 327 - DNA, 722 bp, Zea mays
agcagggacctggcacgcgtgctgcaatggatggcaggaggggagaggaataagaagtgtttccatttcacagtgagagcagtcgagctccaacgttgtcgtcgtcgtcgtcttcttcttttgatattcacactctgtcttgcggtctatatcatcagcataataataataaaataagtaaaaccaaaccatgcatgaccatgctatacatgttgcgagttccagcgagacggttaactataatgactgcaacaaaggattctgttcgttttgacacgtgatcacgtaagaataccgctcaggagaccaacacggatggtctaaaccactatctccaaagtaaaccatactcaagtcttaaaaccgcaagagctacagttgttctgaaatctgaatgtagaactgcccatctgcacagtcagatcgaaacacctccgtttcagagcacagaagatggcgacgggatctctagagatcagtaatcattcaaccgctgcagtattttcatgaacacacgccaggcacgatctaaatgaccgattttataagtgcatatactactcgaccataactccagaaccttgtactctacgcagacggtttttctaggaacagagcttcctgcttgctagtgagaccgagatcgctcagtgacatctggctctccaattcagtgaaggcacgcctgggataagacctcgcctgtccaaagaaaaagggcg

SEQ ID NO: 328 - DNA, 1005 bp, artificial sequence
  synthetic
caggcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatggaagttatggcggaggttcggccaatagcccggagcataaagacggcccacgacgacgcaagggcagaacttatgtctgccgatagaccacgctcaacacgcggactg

SEQ ID NO: 329 - protein, 335 aa, artificial sequence
  synthetic
QAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPPSGAAPPSPTLGFYAAGNGGGSAVLLDTSSDWGSSGAAMATETCFLQDYMGVTDTGSSSQWPRFSSSDTIMAAAAARAATTRAPETLPLFPTCGDDGGSGSSSYLPFWGAASTTAGATSSVAIQQQHQLQEQYSFYSNSNSTQLAGTGNQDVSATAAAAAALELSLSSWCSPYPAAGSMEVMAEVRPIARSIKTAHDDARAELMSADRPRSTRGL

SEQ ID NO: 330 - DNA, 1278 bp, artificial sequence
  synthetic
caggcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgctgaaaattctctcccggaatgctaaactcttgtcacacgcagttcgccacgcagcaactcttccagatggggagcagctgtccgaggcccagcttagccagatgcgctccgaggtggcaacaaggcccgtgctgggtgttgcgtacacacatcaagatggtcagcctgaggagcgcctttcaggtaatcatctggaccacaaaatcaacaacatccccaacttggtctttaacgtggcggagcccattatgttcaatgaaatttccgctctggaggttatggccgaggtcagaccgatagcgagaagcatcaaaactgcacatgatgatgcaagagccgaactgatgtcggcggaccgcccaagatcgacgaggggcctg

SEQ ID NO: 331 - protein, 426 aa, artificial sequence
  synthetic
QAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPPSGAAPPSPTLGFYAAGNGGGSAVLLDTSSDWGSSGAAMATETCFLQDYMGVTDTGSSSQWPRFSSSDTIMAAAAARAATTRAPETLPLFPTCGDDGGSGSSSYLPFWGAASTTAGATSSVAIQQQHQLQEQYSFYSNSNSTQLAGTGNQDVSATAAAAAALELSLSSWCSPYPAAGSMLKILSRNAKLLSHAVRHAATLPDGEQLSEAQLSQMRSEVATRPVLGVAYTHQDGQPEERLSGNHLDHKINNIPNLVFNVAEPIMFNEISALEVMAEVRPIARSIKTAHDDARAELMSADRPRSTRGL

SEQ ID NO: 332 - DNA, 978 bp, artificial sequence
  synthetic
caggcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgccgaaagcggccaatgatgtggatcggttgacacgggacttcgatgagcggatacgggttagaggcgacggcagggggctg

SEQ ID NO: 333 - protein, 326 aa, artificial sequence
  synthetic
QAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPPSGAAPPSPTLGFYAAGNGGGSAVLLDTSSDWGSSGAAMATETCFLQDYMGVTDTGSSSQWPRFSSSDTIMAAAAARAATTRAPETLPLFPTCGDDGGSGSSSYLPFWGAASTTAGATSSVAIQQQHQLQEQYSFYSNSNSTQLAGTGNQDVSATAAAAAALELSLSSWCSPYPAAGSMPKAANDVDRLTRDFDERIRVRGDGRGL

SEQ ID NO: 334 - DNA, 2133 bp, Zea mays
atggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaa

SEQ ID NO: 335 - protein, 710 aa, Zea mays; identical to SEQ ID NO: 116

SEQ ID NO: 336 - DNA, 48 bp, Zea mays; identical to SEQ ID NO: 48

SEQ ID NO: 337 - protein, 16 aa, Zea mays
KQINNWFINQRKRHWK

SEQ ID NO: 338 - DNA, 63 bp, Schizosaccharomyces pombe; identical to SEQ ID NO: 50

SEQ ID NO: 339 - protein, 21 aa, Schizosaccharomyces pombe
AGYLLGKINLKACAACAKKIL

SEQ ID NO: 340 - DNA, 162 bp, Candida albicans; identical to SEQ ID NO: 52

SEQ ID NO: 341 - protein, 54 aa, Candida albicans; identical to SEQ ID NO: 53

SEQ ID NO: 342 - DNA, 63 bp, artificial sequence; identical to SEQ ID NO: 54
  synthetic

SEQ ID NO: 343 - protein, 21 aa, artificial sequence
  synthetic
KETWWETWWTEWSQPKKKRKV

SEQ ID NO: 344 - DNA, 33 bp, human immunodeficiency virus; identical to SEQ ID NO: 56

SEQ ID NO: 345 - protein, 11 aa, human immunodeficiency virus
YGRKKRRQRRR

SEQ ID NO: 346 - DNA, 63 bp, Zea mays
atggcaaaactactcttgggtttgctccttgcccttgctattctagggacaacatcggctgct

SEQ ID NO: 347 - protein, 21 aa, Zea mays
MAKLLLGLLLALAILGTTSAA

SEQ ID NO: 348 - DNA, 1621 bp, Zea mays; identical to SEQ ID NO: 166

SEQ ID NO: 349 - DNA, 72 bp, Zea mays; identical to SEQ ID NO: 169

SEQ ID NO: 350 - protein, 24 aa, Zea mays
MAKLLSLFLALSFVAAMFAIGSHA

SEQ ID NO: 351 - DNA, 1454 bp, Zea mays; identical to SEQ ID NO: 168

SEQ ID NO: 352 - DNA, 1560 bp, Zea mays
atggcaaaactgttgagcctgttcttagccctctcctttgtagcagctatgtttgccataggctctcatgctgacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacactccgaaagcggccaatgatgtggatcggttgacacgggacttcgatgagcggatacgggttagaggcgacggcagggggctggactataaggatgacgacgataagaaacagatcaacaactggtttatcaatcaaaggaagcggcactggaaa

SEQ ID NO: 353 - protein, 520 aa, Zea mays
MAKLLSLFLALSFVAAMFAIGSHADTFGQRTSIYRGVTRHRWTGRYEAHLWDNSCRREGQTRKGRQVYLGGYDKEEKAARAYDLAALKYWGATTTTNFPVSNYEKELEDMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSSALPIGSAAKRLKEAEAAASAQHHHAGVVSYDVGRIASQLGDGGALAAAYGAHYHGAAWPTIAFQPGAASTGLYHPYAQQPMRGGGWCKQEQDHAVIAAAHSLQDLHHLNLGAAGAHDFFSAGQQAAAAAMHGLGSIDSASLEHSTGSNSVVYNGGVGDSNGASAVGGSGGGYMMPMSAAGATTTSAMVSHEQVHARAYDEAKQAAQMGYESYLVNAENNGGGRMSAWGTVVSAAAAAAASSNDNMAADVGHGGAQLFSVWNDTPKAANDVDRLTRDFDERIRVRGDGRGLDYKDDDDKKQINNWFINQRKRHWK

SEQ ID NO: 354 - DNA, 1536 bp, artificial sequence
  synthetic
tgctagtgaacctcaaggattgggggtgataaatgcgtgcttaatttttgaggatctagtaatcaagagtgagaggaggcaaaacatcgattcttcatagtgcttaaatagaaaagagtgataatactactcctttgttcgtcgagtactaaaagactactacatccattttacaattattttttagatacataaactttattattataaatctagacgtagttaagtgcaatgcaaacaacttatattttagtaatacataccattaataaataatcctagtagatagtatatatatctaataagatgatattaaaggatgataataataacaattaataaatactactagtacacaaaagataagtttagcaacaattaagtttagtagtgcatgaagttgttttacgatattgataatatttatcacgcaaattttgtatattatagtgatgttttttgttccatatctatgttttatacaaattttttactgccgcaatgcactgcacatatctagttttagtactatatacaattaataaataatagataatactagcacatagtatatatctaatgaaacgatattaaaaggatggtaataatagcaattaataaatactagtagtatacaaaagataagtttagcaacaatcaaactaaaagatagccagtagaattttatttattttatattactgaaaacatcctcaagtgttcaccctgcagcccatcgcctattctatttaagaaatgcccgccctcccatactgctatcactcaagcctattctccattgtggaaccaacaaatctccaagctctcccaatttagaaacgagccatggccctgtccaacaagttcatcggcgacgacatgaagatgacgtaccacatggacgggtgcgtcaacggccactacttcaccgtcaagggcgaagggtccggtaagccatacgagggcacgcagacctccacattcaaggtcacgatggctaacggtggtccgctggccttctcattcgatatcctgagcaccgtcttcatgtacgggaacaggtgcttcacggcgtacccgacctcaatgccagactacttcaagcaggccttcccggacggcatgtcgtacgagaggaccttcacctacgaggacggtggcgtggcgactgcttcgtgggagatctccctcaagggcaactgcttcgaacacaagtcgacgttccacggcgtgaatttcccagcggacgggccagtcatggcaaagaagacgactggctgggacccgagcttcgagaagatgacggtctgcgacggcatcctcaagggcgacgttacggcttttctcatgctgcagggcggagggaattataggtgccagttccacaccagctacaagacgaagaagccggtcacgatgccgccgaaccacgtcgtcgagcacaggatagcgaggaccgaccttgacaagggcggcaactcggtgcagctcactgagcacgccgtcgcacacatcacgtcagtcgtgccgttctag

SEQ ID NO: 355 - DNA, 63 bp, Thosea asigna virus; identical to SEQ ID NO: 101

SEQ ID NO: 356 - protein, 21 aa, Thosea asigna virus
GSGEGRGSLLTCGDVEENPGP

SEQ ID NO: 357 - DNA, 4104 bp, Streptococcus pyogenes
atggacaagaaatactcaattggtcttgatatcggaacaaacagcgttggatgggcggttattaccgacgaatataaagttccttcgaagaaatttaaagtgcttggaaacacggaccggcactcaatcaagaagaatctgattggagctttgctgtttgattctggtgagactgcggaagcaacacggctgaagcgcaccgcacggcgccgctacacgcggcggaaaaacagaatttgctacctccaagagatttttagcaacgaaatggctaaagtggacgattcttttttccacagacttgaggaatctttcctcgtcgaagaggataaaaagcacgagcgccatcctatttttggtaatatagtggatgaagttgcgtaccatgagaaatatcctacgatttaccacctcaggaagaagctcgtggattctacggacaaagcagaccttcggctcatttatttggccctcgcacacatgattaagttcagaggtcattttcttatcgagggggaccttaatcccgataactccgacgtcgataagcttttcatccagctcgtccaaacctataatcaattgtttgaggagaaccctataaatgcgtcaggagtggacgcaaaagccatcttgagcgctagactctccaaatctcggaggctcgagaatctgatcgcacagcttcctggtgaaaagaagaatggactctttggtaacttgattgcgctctcactcggtctgacacccaatttcaagagcaatttcgaccttgctgaagatgccaagttgcaactctctaaagatacctacgacgacgaccttgacaatctgttggcacaaataggggaccagtacgccgatcttttccttgctgccaaaaatttgtctgacgctattttgttgtccgatattctgcgcgtgaatacggagatcactaaagcccctctttccgctagcatgattaagcggtacgacgagcaccatcaagaccttacgctcctgaaagctctcgtcaggcaacagctcccagaaaagtacaaagaaatattcttcgatcagagcaagaacgggtatgcaggatacattgatgggggagcatcccaagaggagttctataagttcatcaagccgatattggagaaaatggatggaactgaagaactgcttgtcaagttgaatcgcgaagatcttttgaggaaacagaggacttttgataatgggtccatcccgcaccaaattcatttgggagagttgcatgcaatcttgagaagacaggaggatttttacccatttctgaaagacaacagagaaaagatagagaaaatattgactttccgcatcccgtattatgtcggtccactggcgaggggcaatagccgctttgcgtggatgacgaggaaaagcgaggagaccataaccccctggaacttcgaggaagttgtggataagggtgcatccgcacagtcgttcattgaaaggatgaccaacttcgataagaaccttcctaatgagaaagtccttcctaaacactccctgctgtatgagtactttaccgtgtacaacgagctcacgaaagtgaaatatgtcacagaggggatgcgcaagccagccttcctttctggtgaacaaaaaaaggcgatagtcgacttgctctttaaaactaataggaaggtgacagtcaaacagctcaaagaagattattttaaaaaaatagaatgctttgatagcgttgaaatctccggtgtcgaggatcggtttaatgcgtctctgggaacataccacgatcttcttaaaatcattaaagataaagacttccttgacaatgaagaaaacgaagacatattggaggatatagtcctgacccttaccctcttcgaggacagggaaatgatagaggagagacttaaaacgtatgctcatctgtttgatgacaaggttatgaaacagcttaaacggaggcgctacacaggatgggggagactctccagaaaattgataaatgggatccgcgataagcagtctggaaagaccatcctcgacttcttgaaaagcgatggattcgcaaatcggaattttatgcaactcatccatgatgacagcctgacgttcaaggaagatattcaaaaggcacaagttagcgggcaaggtgactctttgcatgaacatatagcgaaccttgcaggttcccccgcgatcaaaaagggaatactccaaacggtgaaagtcgtcgatgaactggttaaagtgatgggacgccataagcccgagaatatagtcatcgaaatggcgagagaaaatcaaaccacgcaaaagggccagaaaaactccagggagcggatgaagagaatagaggaaggcatcaaggagctcgggtctcagatcctcaaagaacatccggtggagaatacgcagttgcaaaacgagaagctctacctttactacctgcaaaatgggagagatatgtacgttgaccaggaattggatattaacaggctttccgactatgacgtcgaccacatcgttccgcagtcgttcttgaaggacgactctatagataataaggttctgacacgcagcgacaaaaaccggggaaagtcagacaatgtccccagcgaagaagttgttaagaaaatgaaaaactattggcggcagctccttaatgctaaattgattacccaacgcaagttcgataaccttacgaaggccgaacgcggcggcttgtccgaactggacaaggcgggattcatcaaacggcaacttgtggaaacccggcagatcacaaaacacgtggcacaaatccttgattctaggatgaataccaaatatgatgagaatgataaactgatacgcgaagtgaaagtgattactttgaagagcaaactcgtgtcagatttccggaaagattttcagttttataaagtcagagagataaataactaccatcatgcacatgatgcatatctgaacgccgtcgtgggaacagctcttataaagaagtaccccaaactggaatctgagttcgtctacggagattacaaagtttacgatgtcagaaagatgatagcaaaatcagagcaagaaataggtaaggctactgctaagtatttcttttactctaacattatgaatttcttcaagaccgaaattaccctggccaacggtgagataagaaagcgccccctcattgaaactaacggcgaaacaggcgagatcgtgtgggataaaggtagagatttcgccacagttcggaaagtgctcagcatgcctcaggtgaacatagttaaaaagactgaggttcagacaggcggattctccaaagaatcaatacttcctaagaggaactcagataaactgattgcaagaaaaaaagactgggatccaaagaaatatggcggttttgactcccccacagtcgcgtactcagtcctggtcgtggccaaggtcgagaaggggaagtccaaaaagctcaagtcagtgaaggagctcctgggcattacgatcatggaaaggtcatcttttgaaaagaacccaattgatttccttgaagccaaggggtataaggaggttaaaaaggacctgatcatcaagcttccgaaatattcactgtttgagctcgaaaatggccgcaagaggatgttggcctctgctggcgaacttcaaaaaggcaacgagcttgctctcccctcgaagtatgtgaattttctgtatctggcctcgcactatgagaaattgaaaggatctccggaagataacgaacaaaagcagcttttcgtcgagcaacataagcactacctcgatgaaataatagaacagatctcagagtttagcaagagggtcatactggccgatgcgaatcttgataaggttctctctgcttataacaaacatagggacaagcctatacgggagcaagccgagaacattattcatctctttaccctcactaatctcggtgcgcctgcggctttcaagtattttgacactacgatagacagaaaacgctatacttcgaccaaggaagtcctggacgcaacccttattcaccagagcattacgggactttatgagacgagaatcgatttgtctcaactcggtggtgat

SEQ ID NO: 358 - protein, 1368 aa, Streptococcus pyogenes [sequence omitted]

SEQ ID NO: 359 - DNA, 3921 bp, Acidaminococcus
atgactcagttcgaaggtttcaccaacctgtaccaagtgtccaaaacgttgaggttcgagctgattccacaggggaaaacgctcaagcatatccaagaacagggcttcattgaggaagataaagctcgcaacgatcactacaaggagcttaagcctattattgacaggatctacaaaacctacgctgatcaatgcctccaactggttcagctggattgggagaatctctccgccgcgatcgattcctaccggaaggagaagacggaagaaacacgcaacgctcttatagaagaacaggcgacgtatcgcaatgctattcacgactattttataggacggactgataatctcacggacgcaatcaataaaaggcatgcagagatctacaaaggtctctttaaagctgaattgtttaacggaaaagttctcaaacaactgggtacagtgactacgacggaacacgagaatgcgctgctgagatccttcgataagttcactacctatttctcgggcttttacgagaacaggaagaatgtgttctccgctgaggatatcagcacagctatacctcaccggatcgtgcaagacaatttcccaaagttcaaagaaaactgtcacatattcacaaggctcattaccgctgtccccagcctgagggaacatttcgagaacgttaaaaaagccattggaatcttcgtctcgacgagcatagaggaggttttctcttttcccttttacaatcaacttctgacccaaacacaaattgatttgtacaaccaattgttgggaggcatatcgagggaggcggggactgagaaaattaagggccttaacgaagtcctgaaccttgcgattcaaaagaatgacgaaacggcgcatattatagcttcacttcctcatcgcttcatcccacttttcaaacaaatcctctccgaccggaatacacttagcttcatactggaggagtttaaatcggacgaggaagtcatacagtccttttgcaagtataaaacgttgctccggaatgaaaatgtcctggaaacggctgaggcgctctttaatgagctgaactcaattgacttgacccacatctttatctcgcataaaaaattggaaactatctcttcagcgctgtgtgatcattgggacaccctcaggaacgcattgtatgaaaggagaatttcagaacttacgggcaagatcaccaaatcagcgaaggaaaaagtgcagcggagcttgaagcatgaagacataaatcttcaagagattatatctgcagcaggcaaagaactgtccgaggcttttaagcagaagacatccgaaattctttctcacgcgcacgcggcattggaccaacccctcccaaccactttgaagaagcaggaggaaaaggagattctgaagtcacagcttgattcgcttctggggctctaccatctgttggattggtttgctgtggacgaatccaatgaagtcgaccccgaattctcagcgaggctcaccggaataaaactggagatggaaccgtccttgtctttctacaataaagccaggaattacgccacgaagaagccatactcagtggagaaatttaaactgaacttccaaatgcctactctggcttcaggttgggatgtcaacaaggagaaaaacaacggagcaatcctttttgtcaagaacggtctctattacctcggaattatgccgaaacagaagggtcgctataaagcactgagctttgaacccacggagaaaacgtccgagggcttcgacaagatgtattatgactatttccccgacgccgcgaaaatgattccgaaatgcagcactcaactcaaggccgtgacagcccactttcagactcacacaactccaatacttttgtcgaataattttattgagcctctcgaaataactaaagagatatatgaccttaataatccagagaaagaaccaaaaaaattccaaactgcctacgctaagaagactggtgatcagaagggctacagagaggcgttgtgtaaatggatcgacttcactagggactttctgtcaaagtacactaaaacaacttctatagatctgagctccctccgcccatcatctcagtacaaggatcttggtgaatactatgccgagctcaacccactcctctaccatatcagcttccagcgcatagctgaaaaagaaataatggatgctgttgaaacaggcaaactgtatctctttcagatctacaacaaggattttgctaaagggcatcacgggaagcctaaccttcacacattgtactggaccggcctcttttcaccagagaatttggcaaaaacttcgattaaactcaacgggcaagcagagcttttctaccggcccaagtcccgcatgaaacgcatggcacacaggctgggagaaaagatgctgaacaagaaattgaaggaccagaagacaccaataccagatactctgtatcaggagctctacgactatgttaaccataggctctctcacgacctctctgacgaagccagggcacttctgcccaatgtgatcacgaaggaggtgtctcacgagataattaaggacagacggttcacgtcggacaagttttttttccatgtcccgattacgctgaactaccaagctgccaactctccatcaaaatttaatcagagggttaatgcgtatttgaaggaacatcctgagactccaatcataggtatagatcggggcgagaggaaccttatttacataaccgttattgattccacgggcaaaattctggagcagcggtcgctgaatacgatacaacaatttgattatcaaaagaagcttgacaatcgcgagaaagaaagggtcgccgcaagacaggcgtggagcgtcgtcggtactataaaggatcttaaacaaggttatttgtcacaagttatacatgaaatagttgaccttatgatacactatcaggctgtcgttgtccttgaaaacctcaactttgggtttaagagcaagcggacaggaattgcagagaaggccgtgtatcagcagttcgaaaagatgcttattgataagctcaactgcctggtgcttaaagactacccagcagagaaagttggcggtgttctgaatccttaccagctcacagaccagtttacttcctttgcaaaaatgggcacccagtcgggtttcctcttttatgttcctgcaccgtatacgtctaagatagatcctctgacaggctttgtggacccctttgtttggaaaactatcaaaaatcatgaatcgaggaaacacttcctcgagggtttcgattttctccactatgatgtgaagactggcgactttatacttcattttaaaatgaaccgcaatctttcgtttcaacgcggacttccaggatttatgccggcctgggatatcgttttcgaaaagaatgagacgcaatttgacgctaagggaacgcctttcatcgcggggaaacggattgtcccggtcatagaaaatcatagatttacgggtcggtacagggacctgtatcccgcgaacgaactcatcgcgcttctcgaagagaaaggtatagtgtttcgcgatggatcaaacatcttgcctaaactcctggaaaacgacgattcacacgctatagacacgatggtggcactgatccgctcggtgctgcagatgcggaattcaaacgctgcgactggggaagactatataaactcaccagtgagagatttgaacggcgtttgctttgattcgcggttccaaaatcccgaatggcccatggacgctgatgccaatggagcgtatcacattgcgcttaagggtcagttgcttctgaaccacttgaaagaatctaaagatcttaagcttcaaaacggtatttcaaaccaagactggctcgcctatatacaggaactccgcaac

SEQ ID NO: 360 - protein, 1307 aa, Acidaminococcus
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 361 - DNA, 1002 bp, Artificial Sequence
  WUS-HISTAG-GZCPP coding sequence
gtgaggctccctcctcccgtgaggctccctccccctctcgtgagaccccctcccttgcatcatcatcatcatcatatggcggctaacgcaggtggtgggggcgcaggaggcggtagcggatcggggtcagtcgcggcacccgcagtgtgcaggccatcaggttctcggtggactccgactccggaacagattcgcatgctcaaggagttgtattacgggtgcggaattaggtcaccatcatctgagcagattcaaaggataacagcaatgttgcggcaacatggtaagatcgagggaaagaatgtcttttactggttccagaatcataaagctcgcgagcgccagaaaaggcggttgacgtccctcgacgtgaatgttcccgcagcgggggccgcagatgcaaccacctcacagttgggtgttctctcgttgtcttctccgccaccatccggcgcagcgcccccgtccccgactctcggattctacgccgcgggaaatggtgggggctccgcagtgttgctggacacatcttctgactggggaagctctggggcggcgatggccacagagacatgctttttgcaggactacatgggcgttacagataccgggtcctcgtcgcagtggccacggttttcctcctccgacaccataatggcggctgctgctgccagggcagcgacaacaagggctccggagacacttcctctgttcccaacgtgcggagatgacggtgggtcgggttcgtccagctacctccctttctggggcgcagcgagcactaccgcgggcgcaacgtctagcgtcgccatccaacaacaacatcaattgcaggaacaatattcgttctattcaaactcaaattctacgcaactggcaggcacagggaatcaagacgtgtcggctaccgctgcagcggcagctgcacttgagttgtctctcagctcatggtgtagcccctatcctgcagccgggtcgatggggcatcatcatcatcatcat

SEQ ID NO: 362 - protein, 334 aa, Artificial Sequence
  WUS-HISTAG-GZCPP protein sequence
VRLPPPVRLPPPLVRPPPLHHHHHHMAANAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPPSGAAPPSPTLGFYAAGNGGGSAVLLDTSSDWGSSGAAMATETCFLQDYMGVTDTGSSSQWPRFSSSDTIMAAAAARAATTRAPETLPLFPTCGDDGGSGSSSYLPFWGAASTTAGATSSVAIQQQHQLQEQYSFYSNSNSTQLAGTGNQDVSATAAAAAALELSLSSWCSPYPAAGSMGHHHHHH

SEQ ID NO: 363 - DNA, 1773 bp, Artificial Sequence
  WUS-GR coding sequence
atggctgctaacgccggcggcggaggagccggaggcggaagtggcagtggctcggttgccgcgcctgccgtatgtaggcctagtggttccagatggactccaacacctgagcagatacgcatgctcaaggaactttactacggttgtggtatccgctcgccttctagtgaacagattcaacgcataacagcgatgttgcgtcagcacggcaaaatcgaaggcaaaaacgtattttactggtttcaaaatcataaagcccgcgagcgtcaaaagaggagactcacgagtttggacgtgaacgtacctgctgccggagctgccgacgccaccacgtcccaacttggagttctgagtcttagctccccgccgccttccggagccgccccaccgagtcccactcttggattttatgccgctggaaatggaggaggttccgccgtgcttttggacacttcgtctgattggggttccagcggcgctgcaatggcgactgagacttgtttccttcaggactatatgggtgtcaccgatacgggaagttcatcacaatggcccaggttttcaagtagtgacactataatggctgcggctgccgcgagagcagctacgaccagggcacccgagacactgcctctcttcccaacttgcggtgacgacggcggctccggttcctcgagttatttgcctttctggggcgcggcctccacaacagcaggcgcgacaagttccgttgcaatccagcagcaacatcaacttcaggagcagtatagtttttactccaatagtaactccacccaactcgcgggcacgggcaaccaagacgtgagtgcgacagcagcggcagcagcggctttggagctgagtctgtcttcgtggtgctctccctatccagcggcaggttcaatgggagaagctcgcaaaactaaaaaaaaaataaagggcattcaacaagctacggccggagtgagccaggacactagcgagaaccctaacaagacaatcgtcccggcggcacttccgcaactcacccctacgctggtctcgcttttggaggttatagaacctgaagtgctctacgcaggctatgactcgagcgtccctgattctgcgtggcggataatgactactttgaatatgctggggggtcgccaggttattgccgcagtgaaatgggccaaagcaatcttgggactccgcaatctgcacctcgacgaccaaatgactctcctccaatatagctggatgtttctgatggcctttgcgctgggttggcgcagctataggcagtcatcaggtaacctcttgtgtttcgcccctgatttgataattaacgaacagcggatgtctcttccctgtatgtatgaccagtgtaaacatatgttgtttgtgtcatcagagcttcagagacttcaggtgagctacgaagaatatctttgtatgaaaacacttcttttgttgagcagcgtgcctaaggagggccttaagagccaggaactcttcgatgaaatcagaatgacttatatcaaagaacttggcaaagcaattgtgaaacgggaaggaaatagctcgcagaactggcaacggttctaccagttgacgaaactgttggattcgatgcacgaggtcgtcgaaaacttgcttacctactgttttcaaacattcctcgataaaaccatgagcatagagtttccagagatgttggccgaaataattacaaaccagatacccaaatactcaaatggcaatattaagaaacttctgtttcaccaaaaa

SEQ ID NO: 364 - protein, 591 aa, Artificial Sequence
  WUS-GR protein sequence
MAANAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPPSGAAPPSPTLGFYAAGNGGGSAVLLDTSSDWGSSGAAMATETCFLQDYMGVTDTGSSSQWPRFSSSDTIMAAAAARAATTRAPETLPLFPTCGDDGGSGSSSYLPFWGAASTTAGATSSVAIQQQHQLQEQYSFYSNSNSTQLAGTGNQDVSATAAAAAALELSLSSWCSPYPAAGSMGEARKTKKKIKGIQQATAGVSQDTSENPNKTIVPAALPQLTPTLVSLLEVIEPEVLYAGYDSSVPDSAWRIMTTLNMLGGRQVIAAVKWAKAILGLRNLHLDDQMTLLQYSWMFLMAFALGWRSYRQSSGNLLCFAPDLIINEQRMSLPCMYDQCKHMLFVSSELQRLQVSYEEYLCMKTLLLLSSVPKEGLKSQELFDEIRMTYIKELGKAIVKREGNSSQNWQRFYQLTKLLDSMHEVVENLLTYCFQTFLDKTMSIEFPEMLAEIITNQIPKYSNGNIKKLLFHQK

SEQ ID NO: 365 - DNA, 15 bp, Artificial Sequence
  ERF motif 1
cgcctgttcggcgtc

SEQ ID NO: 366 - DNA, 15 bp, Artificial Sequence
  ERF motif 2
aagctgttcggcgtc

SEQ ID NO: 367 - DNA, 27 bp, Artificial Sequence
  AP2/ERF motif 1
cactaccgcggcgtccgcaagcgcccg

SEQ ID NO: 368 - DNA, 27 bp, Artificial Sequence
  AP2/ERF motif 2
cgcttccgcggcgtccgcaagcgcccg

SEQ ID NO: 369 - DNA, 18 bp, Artificial Sequence
  TLLLFR motif
accctgctgctgttccgc

SEQ ID NO: 370 - DNA, 18 bp, Artificial Sequence
  Dr1-like
accctgctgctgcagccg

SEQ ID NO: 371 - DNA, 18 bp, Artificial Sequence
  Zinc Finger motif (DLN-like)
ttcgacctgaacctgccg

SEQ ID NO: 372 - DNA, 15 bp, Artificial Sequence
  B3 motif
cgcatcggccgcctg

SEQ ID NO: 373 - protein, 5 aa, Artificial Sequence
  ERF motif 1
RLFGV

SEQ ID NO: 374 - protein, 5 aa, Artificial Sequence
  ERF motif 2
KLFGV

SEQ ID NO: 375 - protein, 9 aa, Artificial Sequence
  AP2/ERF motif 1
HYRGVRKRP

SEQ ID NO: 376 - protein, 9 aa, Artificial Sequence
  AP2/ERF motif 2
RFRGVRKRP

SEQ ID NO: 377 - protein, 6 aa, Artificial Sequence
  TLLLFR motif
TLLLFR

SEQ ID NO: 378 - protein, 6 aa, Artificial Sequence
  Dr1-like
TLLLQP

SEQ ID NO: 379 - protein, 6 aa, Artificial Sequence
  Zinc Finger motif (DLN-like)
FDLNLP

SEQ ID NO: 380 - protein, 5 aa, Artificial Sequence
  B3 motif
RIGRL

SEQ ID NO: 381 - DNA, 180 bp, Artificial Sequence
  RLFGV-like-1
cgcccgcgctatcgcggcgtgcgccagcgcccgtggggcaaatgggcggcggaaattcgcgatccggtgaaagcggcgcgcgtgtggctgggcacctttgcgaccgcggaagatgcggcgcgcgcgtatgatgatgcggcgctgcgctttcgcggcgcgaaagcgaaactgaactttccg

SEQ ID NO: 382 - DNA, 174 bp, Artificial Sequence
  RLFGV-like-2
cgctttcgcggcgtgcgcaaacgcccgtggggccgctatgcggcggaaattcgcgatccggcgaaaaaagcgcgcgtgtggctgggcacctttgatagcgcggaagatgcggcgcgcgcgtatgatgcggcggcgcgcatgctgcgcggcccgaaagcgcgcaccaactttccg

SEQ ID NO: 383 - DNA, 174 bp, Artificial Sequence; identical to SEQ ID NO: 382
  RLFGV-like-3

SEQ ID NO: 384 - DNA, 174 bp, Artificial Sequence
  RLFGV-like-4
cgctttcgcggcgtgcgcaaacgcccgtggggccgctttgcggcggaaattcgcgatccggcgcgcaaagcgcgcgtgtggctgggcacctttgataccgcggaagcggcggcgcgcgcgtatgatgcggcggcgctgcattttcgcggcccgaaagcgaaaaccaactttccg

SEQ ID NO: 385 - DNA, 291 bp, Triticum aestivum
ccgtttacccaggcgccgccgcagcagccgctgcatccgcagctgcagcagtatacccaggcgccgccgcagcagccgctgcagccgccgctgcagctgtatccgcaggcgcagccggaacagccgctgcagccgcagagcagcggcagcaccaccggcacctgcgtgattagcgcggcggcgccgagcgcgaccggcaccctgctgctgcagccgccgccgcagcagagcccgcagagccagctgcagctgcatcagcagccgcagccgaccctggtgccgccgccgcag

SEQ ID NO: 386 - DNA, 261 bp, Artificial Sequence
  Dr1-associated corepressor-like 1
aaaaaactgacccgctttccgattagccgcctgaaacgcattatgcagctgaacgaagatattggcaaaattggcgcgagcgtgccggtggtggcgagcaaagcgattgaaatgtttctgaccgaaattgtgggcctgaccctgaaagaagcgcgcaaaaaaagcagcagccgcatgagcagcgaatttattattcgcgcgaccgaaagcgatccgaaatttgcgtttctgaaaaacatggaacagtttaaaaaccgcgaa

SEQ ID NO: 387 - DNA, 291 bp, Artificial Sequence
  Dr1-associated corepressor-like 2
ccggtgggcaacatgggcaccaacagcaacaacaacaacgaactgggcgatgtgtttgatcgcattaaaacccattttccgccggcgaaagtgaaaaaaattatgcagaccgatgaagatattggcaaagtgagccaggcgaccccggtgattgcgggccgcagcctggaattttttattgcgctgctggtgaaaaaaagcggcgaaatggcgcgcggccagggcaccaaacgcattaccgcggaaattctgaaaaaaaccattctgaacgatgaaaaatttgattttctg

SEQ ID NO: 388 - DNA, 276 bp, Artificial Sequence
  Dr1-associated corepressor-like 3
ccgaccaacaacaacgatagcgaaaccaaaccgaacccggcgacctattggaaaagccgctttccggtggcgcgcattaaaaaaattatgcaggcggatcaggatgtgggcaaagtggcgcaggtgaccccggtgattatgagcaaagcgctggaactgtttatgcagagcattattcaggaaagctgcaaacagacccgcctgcatcaggcgaaacgcgtgaccgtgagccatctgaaacatgcggtgcagagcgtggaacagtttgattttctg

SEQ ID NO: 389 - protein, 60 aa, Artificial Sequence
  RLFGV-like-1
RPRYRGVRQRPWGKWAAEIRDPVKAARVWLGTFATAEDAARAYDDAALRFRGAKAKLNFP

SEQ ID NO: 390 - protein, 58 aa, Artificial Sequence
  RLFGV-like-2
RFRGVRKRPWGRYAAEIRDPAKKARVWLGTFDSAEDAARAYDAAARMLRGPKARTNFP

SEQ ID NO: 391 - protein, 58 aa, Artificial Sequence; identical to SEQ ID NO: 390
  RLFGV-like-3

SEQ ID NO: 392 - protein, 58 aa, Artificial Sequence
  RLFGV-like-4
RFRGVRKRPWGRFAAEIRDPARKARVWLGTFDTAEAAARAYDAAALHFRGPKAKTNFP

SEQ ID NO: 393 - protein, 97 aa, Triticum aestivum
PFTQAPPQQPLHPQLQQYTQAPPQQPLQPPLQLYPQAQPEQPLQPQSSGSTTGTCVISAAAPSATGTLLLQPPPQQSPQSQLQLHQQPQPTLVPPPQ

SEQ ID NO: 394 - protein, 87 aa, Artificial Sequence
  Dr1-associated corepressor-like 1
KKLTRFPISRLKRIMQLNEDIGKIGASVPVVASKAIEMFLTEIVGLTLKEARKKSSSRMSSEFIIRATESDPKFAFLKNMEQFKNRE

SEQ ID NO: 395 - protein, 97 aa, Artificial Sequence
  Dr1-associated corepressor-like 2
PVGNMGTNSNNNNELGDVFDRIKTHFPPAKVKKIMQTDEDIGKVSQATPVIAGRSLEFFIALLVKKSGEMARGQGTKRITAEILKKTILNDEKFDFL

SEQ ID NO: 396 - protein, 92 aa, Artificial Sequence
  Dr1-associated corepressor-like 3
PTNNNDSETKPNPATYWKSRFPVARIKKIMQADQDVGKVAQVTPVIMSKALELFMQSIIQESCKQTRLHQAKRVTVSHLKHAVQSVEQFDFL

SEQ ID NO: 397 - DNA, 27 bp, Arabidopsis thaliana
accctgccgctgtttccgacctgcggc

SEQ ID NO: 398 - protein, 9 aa, Arabidopsis thaliana
TLPLFPTCG

SEQ ID NO: 399 - DNA, 34830 bp, Artificial Sequence
  RV028329
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccagatcttggccaaggtaccttcgaaattgggtcatcggatcccgggccgctcattaattaagtcatctagttgaaggatcgctatcaactttgtatagaaaagttgggccgaattcgagctcggtacggccagaatggcccggaccgaagcttcggccgcacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattactctatcagtgatagagtgggggatctcgactctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattcacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccactctatcagtgatagagtgtaataaatagactctatcagtgatagagtgaactctatcagtgatagagtacaccccctccacaccctctttccccaacctcgtgttgttcggagcgcacacacacacaaccagatctcccccaaatccacccgtcggcacctccgcttcaagaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcagatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaagcgtacgtgccggcctggctctccgaaagggcgaattccagcacactggcggccgttactagacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccgatctcccgggcacccagctttcttgtacaaagtggccgttaacggatcggccagaatggcccggaccgggttaccgaattcgagctcggtaccctgggatcggccgctctagaactagtggatcccggccgtgatccccggcggtgtccgccactgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtccggtccgctcgaggcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccatagagatgctcgatccgcacaagattcactacttacccttggaaggggaaagctggcaagatttcttgaggaacagggctaagtccatgagaaatgctttgctcagtcaccgtgatggagccaaggtctgtctaggtacgggcttcacggagcgacaatatgaaactgctgagaacacgcttgccttcctgacacaacaaggtttctcccttgagaacgccctctacgcattccaagcagtggggatctacactctgggttgtgtcttgctggatcaagagctgcaagtcgctaaggaggagagggaaacacctactactgatagtatgccgccactggttcgacaagcttacgaactcgcggatcaccaaggtgcagagccagccttcctgttcggccttgaactgatcatatcaggattggagaagcagctgaaggccgaaagtgggtcttaatgatagctgcagaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattcctgcagcccaacggatcggccagaatggcccggaccgggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattcctgcagcccgggcaactttattatacaaagttgatagatcctcatgtcttcatcgtaagcttgatatcgaacgttgctagttcattttatttggtatgtttctaatgctctcaatgttgtggcgatgggataactactgattcaaggcctatttacaaaaataagggctcatgtatatctatttagatattgacatttgtcaaacaacagataagctatatatgatatggcacttagtcaattttgacatttagttatcaattaggctggttagcttaatcattcggactaggcaaaaattttgggctaaggatattcaatatggctaaaatatttaaaaagaacaacttcaattcactcctaatccaaacgagggaaaaaccttttcatggactttgttactattccttttttatttatgaagaaattaattgtatgactgtgaaataatgactgcagttgttgtgctcactgaaagagcaaggagcgcaaggagggcaaatatcatgggctccaaatatttccttacatgttgtattatagggtcatgcacaatttgggttctagcaaaaaacatatgcaccaaatttttactaaaaacaataactaagaggtaagacttcgcgcgaacaactttgcacacacatataggtttactcatgaacttatattatgttttgcttggtatatgtgcacctgatttgagtgttcacggtcaaagcatatgtgccaatcactttctcaaaagaacatatcacagatttaagtactcaactacaagcacgtacagtcacatctatcttataaacacacaagcacacatccaaacaagaacattcaagcggttcgagctggcacatctttggcttggtgaagtatgcggtattgtctacatattaaccaagcatgtatctttaattttgatttgatgttttcaaatgaatatacaaagaacactcttaagaaattgactcaaattaattctcaaacaatatattgattatttattggaagttgcacacgccgatatatatgagacctttgttatgaagtacaactcatatgtattctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctccttttttttacaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagataacttcgtatagcatacattatacgaagttattgatcagaagaaactatgtgctgtagtatagccgctgcccgctggctagctagctagttgagtcatttagcggcgatgattgagtaataatgtgtcacgcatcaccatgcatgggtggcagtctcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtcaacggaagcgagtcgacctcgagggggggccccggccgaagcttcggccggggcccatcgataacgagtatcggtccccattgacacatctactcctaacgctaacaacattcttcacttctagtgtatggcatcgacaattggtactttaatcttgggtcttcacttttacaactaaacaacccaaatataaatattatttgagtgggtttggtgttcatcagaacattcccatctttggtaatgctacctagcataaaagtgagctatcacgttgggcagcccattccatgcaatttttaccttcctcaaaaaaaatctttgatatatttatggtataataatttaaacttcacattgatcataattttttcagcaaataagttccataatttggtgtttgcaatatcgaaattgttactcatagggtccagttgatttaatgacattagtgttgttaagttcacatgcttcaaagaattctacatgtctacaatgctgcatttgtctgtaaaatttgggttcttgtaaaaaatacatgtgttgaatatttaccaaaaaaatataatgcgatatgactttgtgtgagcatgtttggacacagttacaagtttacttctaaacttatattatgttttgcttcgtgcaagtacaagtgatttgaatatccaaggccaaagcatgtgtccatcactatatcaaatcaacataccatatatgtatatactcaacaaaaagcacaaataatcacatctatgttataaacacacccccacacaaccaaacattaacattcaataggttgtgctaggacatcattgggatgatgaagtaatattgtattatctatgtattgaccaagcatgagtttaaaattacgatttgatgttttcagttatttatatgatgaacatagttcagaaatatatcgagataaatctcaatcaatatattgattatttctaggaaacacatgccggtatgagggcaccattgtcgagtacatcttaagtgagaccgggttaccgcggccgcgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcgctccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtggatccgccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgataggtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggagagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatcccgcgccacctccgctttagttctgcatacagccaacccaaggatccaacacacacccgaggatatcacagtcgaccgccggggatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacccctcgctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaagaattcataacttcgtatagcatacattatacgaagttataccatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagatccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 400 - DNA, 37329 bp, Artificial Sequence
  RV028330
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccagatcttggccaaggtaccttcgaaattgggtcatcggatcccgggccgctcattaattaagtcatctagttgaaggatcgctatcaactttgtatagaaaagttgggccgaattcgagctcggtacggccagaatggcccggaccgaagcttcggccgcacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagccgcgggtttctggagtttaatgagctaagcacatacgtcagaaaccattattgcgcgttcaaaagtcgcctaaggtcactatcagctagcaaatatttcttgtcaaaaatgctccactgacgttccataaattcccctcggtatccaattactctatcagtgatagagtgggggatctcgactctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactgatgtctctggaatggaaggaggaggaagtgagcatagcgttggtgcgttgctgtcaagggcgaattcacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccactctatcagtgatagagtgtaataaatagactctatcagtgatagagtgaactctatcagtgatagagtacaccccctccacaccctctttccccaacctcgtgttgttcggagcgcacacacacacaaccagatctcccccaaatccacccgtcggcacctccgcttcaagaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcagatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaagcgtacgtgccggcctggctctccgaaagggcgaattccagcacactggcggccgttactagacccaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccgatctcccgggctcgaggaaaatcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactagactctatcagtgatagagtgtatataagactctatcagtgatagagtgaactctatcagtgatagagttgtacttatttttacaacaattaccaacaacaacaaacaacaaacaacattacaattactatttacaattacagtcgacggatcaagtgcaaaggtccgccttgtttctcctctgtctcttgatctgactaatcttggtttatgattcgttgagtaattttggggaaagcttcgtccacagtttttttttcgatgaacagtgccgcagtggcgctgatcttgtatgctatcctgcaatcgtggtgaacttatttcttttatatccttcactcccatgaaaaggctagtaatctttctcgatgtaacatcgtccagcactgctattaccgtgtggtccatccgacagtctggctgaacacatcatacgatattgagcaaagatcgatctatcttccctgttctttaatgaaagacgtcattttcatcagtatgatctaagaatgttgcaacttgcaaggaggcgtttctttctttgaatttaactaactcgttgagtggccctgtttctcggacgtaaggcctttgctgctccacacatgtccattcgaattttaccgtgtttagcaagggcgaaaagtttgcatcttgatgatttagcttgactatgcgattgctttcctggacccgtgcagctgcggacggatccatggcgcccagcagctacgaggtggcggcttccatcctcctctgcgccgaggacagcagcagcatcctggacctcgaagcggaggccgaggaggaagcgctactggcgcggagcggggagcccggcggcggcgcggagttccccgtgccgtccgaggaatgcgtcgccggtttcctggagtctgaggcagcgcacatgccgcgggaggactacgccgagaggctgcgcagcggggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcacccagctttcttgtacaaagtggccgttaacggatcggccagaatggcccggaccgggttaccgaattcgagctcggtaccctgggatcggccgctctagaactagtggatcccggccgtgatccccggcggtgtccgccactgaagaaactatgtgctgtagtatagccgctgcccgctggctagctagctagttgagtcatttagcggcgatgattgagtaataatgtgtcacgcatcaccatgcatgggtggcagtgtcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtccggtccgctcgaggcatgcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactctagaggatccatggccagactcgacaagagcaaggtgatcaacagcgcactggagctgctgaacgaggtcggaatcgaaggcctcacaacccgtaagctcgcccagaagctcggggttgagcagcctacattgtactggcacgtcaagaacaagcgagctctgctagacgctatggccatagagatgctcgatccgcacaagattcactacttacccttggaaggggaaagctggcaagatttcttgaggaacagggctaagtccatgagaaatgctttgctcagtcaccgtgatggagccaaggtctgtctaggtacgggcttcacggagcgacaatatgaaactgctgagaacacgcttgccttcctgacacaacaaggtttctcccttgagaacgccctctacgcattccaagcagtggggatctacactctgggttgtgtcttgctggatcaagagctgcaagtcgctaaggaggagagggaaacacctactactgatagtatgccgccactggttcgacaagcttacgaactcgcggatcaccaaggtgcagagccagccttcctgttcggccttgaactgatcatatcaggattggagaagcagctgaaggccgaaagtgggtcttaatgatagctgcagaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattcctgcagcccaacggatcggccagaatggcccggaccgggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgactagctagtcagttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattcctgcagcccgggcaactttattatacaaagttgatagatcctcatgtcttcatcgtaagcttgatatcgaacgttgctagttcattttatttggtatgtttctaatgctctcaatgttgtggcgatgggataactactgattcaaggcctatttacaaaaataagggctcatgtatatctatttagatattgacatttgtcaaacaacagataagctatatatgatatggcacttagtcaattttgacatttagttatcaattaggctggttagcttaatcattcggactaggcaaaaattttgggctaaggatattcaatatggctaaaatatttaaaaagaacaacttcaattcactcctaatccaaacgagggaaaaaccttttcatggactttgttactattccttttttatttatgaagaaattaattgtatgactgtgaaataatgactgcagttgttgtgctcactgaaagagcaaggagcgcaaggagggcaaatatcatgggctccaaatatttccttacatgttgtattatagggtcatgcacaatttgggttctagcaaaaaacatatgcaccaaatttttactaaaaacaataactaagaggtaagacttcgcgcgaacaactttgcacacacatataggtttactcatgaacttatattatgttttgcttggtatatgtgcacctgatttgagtgttcacggtcaaagcatatgtgccaatcactttctcaaaagaacatatcacagatttaagtactcaactacaagcacgtacagtcacatctatcttataaacacacaagcacacatccaaacaagaacattcaagcggttcgagctggcacatctttggcttggtgaagtatgcggtattgtctacatattaaccaagcatgtatctttaattttgatttgatgttttcaaatgaatatacaaagaacactcttaagaaattgactcaaattaattctcaaacaatatattgattatttattggaagttgcacacgccgatatatatgagacctttgttatgaagtacaactcatatgtattctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctccttttttttacaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagataacttcgtatagcatacattatacgaagttattgatcagaagaaactatgtgctgtagtatagccgctgcccgctggctagctagctagttgagtcatttagcggcgatgattgagtaataatgtgtcacgcatcaccatgcatgggtggcagtctcagtgtgagcaatgacctgaatgaacaattgaaatgaaaagaaaaaagtattgttccaaattaaacgttttaaccttttaataggtttatacaataattgatatatgttttctgtatatgtctaatttgttatcatccatttagatatagacaaaaaaaatctaagaactaaaacaaatgctaatttgaaatgaagggagtatatattgggataatgtcgatgagatccctcgtaatatcaccgacatcacacgtgtccagttaatgtatcagtgatacgtgtattcacatttgttgcgcgtaggcgtacccaacaattttgatcgactatcagaaagtcaacggaagcgagtcgacctcgagggggggccccggccgaagcttcggccggggcccatcgataacgagtatcggtccccattgacacatctactcctaacgctaacaacattcttcacttctagtgtatggcatcgacaattggtactttaatcttgggtcttcacttttacaactaaacaacccaaatataaatattatttgagtgggtttggtgttcatcagaacattcccatctttggtaatgctacctagcataaaagtgagctatcacgttgggcagcccattccatgcaatttttaccttcctcaaaaaaaatctttgatatatttatggtataataatttaaacttcacattgatcataattttttcagcaaataagttccataatttggtgtttgcaatatcgaaattgttactcatagggtccagttgatttaatgacattagtgttgttaagttcacatgcttcaaagaattctacatgtctacaatgctgcatttgtctgtaaaatttgggttcttgtaaaaaatacatgtgttgaatatttaccaaaaaaatataatgcgatatgactttgtgtgagcatgtttggacacagttacaagtttacttctaaacttatattatgttttgcttcgtgcaagtacaagtgatttgaatatccaaggccaaagcatgtgtccatcactatatcaaatcaacataccatatatgtatatactcaacaaaaagcacaaataatcacatctatgttataaacacacccccacacaaccaaacattaacattcaataggttgtgctaggacatcattgggatgatgaagtaatattgtattatctatgtattgaccaagcatgagtttaaaattacgatttgatgttttcagttatttatatgatgaacatagttcagaaatatatcgagataaatctcaatcaatatattgattatttctaggaaacacatgccggtatgagggcaccattgtcgagtacatcttaagtgagaccgggttaccgcggccgcgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcgctccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtggatccgccatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgctatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccaacagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgataggtaccgttaaccgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtcaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccggtaccgagctcgaattccggagagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatcccgcgccacctccgctttagttctgcatacagccaacccaaggatccaacacacacccgaggatatcacagtcgaccgccggggatccaccatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacccctcgctcaaacgagcaggaagcaacgagagggtggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataatctcttcgcttcttcatttgtccccttgcggagtttggcatccattgatgccgttacgctgagaacagacacagcagacgaaccaaaagtgagttcttgtatgaaactatgacccttcatcgctaggctcaaacagcaccccgtacgaacacagcaaattagtcatctaactattagcccctacatgtttcagacgatacataaatatagcccatccttagcaattagctattggccctgcccatcccaagcaatgatctcgaagtatttttaatatatagtatttttaatatgtagcttttaaaattagaagataattttgagacaaaaatctccaagtatttttttgggtattttttactgcctccgtttttctttatttctcgtcacctagtttaattttgtgctaatcggctataaacgaaacagagagaaaagttactctaaaagcaactccaacagattagatataaatcttatatcctgcctagagctgttaaaaagatagacaactttagtggattagtgtatgcaacaaactctccaaatttaagtatcccaactacccaacgcatatcgttcccttttcattggcgcacgaactttcacctgctatagccgacgtacatgttcgttttttttgggcggcgcttactttcttccccgttcgttctcagcatcgcaactcaatttgttatggcggagaagcccttgtatcccaggtagtaatgcacagatatgcattattattattcataaaagaattcataacttcgtatagcatacattatacgaagttataccatgcaaaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagatccatggatattcgaacgcgtaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgagcttgatatcgaattcctgcagcccatccctcagccgcctttcactatcttttttgcccgagtcattgtcatgtgaaccttggcatgtataatcggtgaattgcgtcgattttcctcttataggtgggccaatgaatccgtgtgatcgcgtctgattggctagagatatgtttcttccttgttggatgtattttcatacataatcatatgcatacaaatatttcattacactttatagaaatggtcagtaataaaccctatcactatgtctggtgtttcattttatttgcttttaaacgaaaattgacttcctgattcaatatttaaggatcgtcaacggtgtgcagttactaaattctggtttgtaggaactatagtaaactattcaagtcttcacttattgtgcactcacctctcgccacatcaccacagatgttattcacgtcttaaatttgaactacacatcatattgacacaatattttttttaaataagcgattaaaacctagcctctatgtcaacaatggtgtacataaccagcgaagtttagggagtaaaaaacatcgccttacacaaagttcgctttaaaaaataaagagtaaattttactttggaccacccttcaaccaatgtttcactttagaacgagtaattttattattgtcactttggaccaccctcaaatcttttttccatctacatccaatttatcatgtcaaagaaatggtctacatacagctaaggagatttatcgacgaatagtagctagcatactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtcacggtctcgatctttggccttggtagtttgggtgggcgagaggcggcttcgtgcgcgcccagatcggtgcgcgggaggggcgggatctcgcggctggggctctcgccggcgtggatcaggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaaggatccacacgacaccatgtcccccgagcgccgccccgtcgagatccgcccggccaccgccgccgacatggccgccgtgtgcgacatcgtgaaccactacatcgagacctccaccgtgaacttccgcaccgagccgcagaccccgcaggagtggatcgacgacctggagcgcctccaggaccgctacccgtggctcgtggccgaggtggagggcgtggtggccggcatcgcctacgccggcccgtggaaggcccgcaacgcctacgactggaccgtggagtccaccgtgtacgtgtcccaccgccaccagcgcctcggcctcggctccaccctctacacccacctcctcaagagcatggaggcccagggcttcaagtccgtggtggccgtgatcggcctcccgaacgacccgtccgtgcgcctccacgaggccctcggctacaccgcccgcggcaccctgcgcgccgccggctacaagcacggcggctggcacgacgtcggcttctggcagcgcgacttcgagctgccggccccgccgcgcccggtgcgcccggtgacgcagatctgagtcgacctgcaggcatgccgctgaaatcaccagtctctctctacaaatctatctctctctataataatgtgtgagtagttcccagataagggaattagggttcttatagggtttcgctcatgtgttgagcatataagaaacccttagtatgtatttgtatttgtaaaatacttctatcaataaaatttctaattcctaaaaccaaaatccagtggcgagctcgagccagggtgcttcctcaagagtcgacctgcagatgcttcggtcctagcgtatacgaagttcctattccgaagttcctattctccagaaagtataggaacttctgtacacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 401 - DNA, 24662 bp, Artificial Sequence
  RV034409
gtttacccgccaatatatcctgtcaaacactgcggccgcacttgaccgcggatggagccggagctgtggtgaggccatcgacgggaggtgggggagaacacagtctcagtgttctttgtgagtccgcaaggtttttagcttttctgtattaattaaggttgctgttggctgtagaatacggtcgtggaagagctgtatcggtagctactacgtaagctattatatactggaagtctggagctcgtcgatctccggtcgtcttcctccatttctcctcgtcttgctttgactgctgctaccatttgcttctgttttctgatgaagcatgccatgtcggccaccagtgtttgtgtggtttttgcagggaatggctttcaagtgctgtgattgaatggccctcgtcgtcctcggctgagctcacatggacgcgtcatgtgagtgagatatatgatcatatgatgagtggggttcgggtgagtgcgtacttgaagtaggatcccgctttcactcattcattcattggcctttaaaccgggaaattttcgcgaggagatggagggaagcaagcagggtgacgagtgcagagtgccgcgagcgctttgtcaaaaggcaccgccgtaggcaaaaaaatcaatggccctgactgactcgatggtagtactactgtagagactagagagggttgctccccatatcttcgtgtgacttttactccagcattgcatttccgtcattgagacgttaattaatagcagctttcgggacagatgactgtggccatgtttcgtcacggccgcttcgtgccagctgggggtactatagtactgtgattttgttagtaaaaactttcattaggccaccattgacgaccgggccttcgcttttgctgcgctaattaaccatttcccggcgaccgaagggaacatgaacatgccccgacacatgagggcatgaggactagtgttctccctgtcgttcgttgacttgactagtgatagtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagataacttcgtatagcatacattatacgaagttatgggcccacgcgtgaagagcggttaccagagctggtcacctttgtccaccaagatggaactgtcttcggccagaatggccatctggattcagcaggcctagaaggccatttatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgaagcttgcatgcctgcatctagaactaccagcagcatgatcagagtgaggatagttgctacttcaatggcctaggtttgataactactgtcgatccatctgtcgacaattgtttgtttcctctcacaattcacgtttctgccgccacttctttgcacctaacattgcccgtgtcgctgttattagttttgtggttttgcattgtctgtatatagtctgatgaggctatagattgagccttcaaaagtgtttcgttgggcctcttgttgaatgtactccaaagtctcggtgcaccatcagacgtattcctagaatggcacaatctggctatcagaactggtaggtttagtccaaatgtaatgatgtgttctaaagtagtcgggctgagtcaaacagcagcttcttctcttgttcaaaattttgaacctggtaatgttgtcatttcatgatagatcatagatacattcttggtttcactatatcttagaaagtccagccaacagaagtactcaagtacaggtgaacctttcagtttagctggagacatgggcagcagtgtacaaagtctaatccacagctgtgaccctgtgagctgggggttgggcctgcctcggaggggatcgtgtcttttctgtttgtgcaattatcagtgcctaaagaacatgtgttataacagttatacacggtcaattattcaatccatcttttaacgtgtgtttggttgtacgtataagaagggatcaaagagggcggccacattttctataacatttggatgagagtcacacgagaacgagatgaacaccgaagtaattttttatgacagcatgatccaaaaaaatcgagagaacggtgttatccccgtctcatcctattttgatctcaaaccaaacacataattagtcaatgagcactgacttgatgtagaagaacttggtacatataccaggaaatgactctgacttgctgagatgccttgtagtccctcggtcccgtaaattatacagtagtatttaaacttcctcgcacaaaggaaaactatttgtttttgcatgccttgtaaattagctatcaagtttttttttaaaaaaaacgacctttgaaaaccagtaaggaggactcgttcggtattcagttttaaagttcaaggttaaaaatcgaactgacgtgcaaaacaccctgggggttaaaatcaaaacacacaaatttggaaaatgagcaggcatgacttatgttgtgtccgttgaagtgccgtggctccatggcacggtggaactttacattagtgcggtagtgtcactgtggcagtaaagcccacttattttccattagagagagggagattaaaaacgtggctttacacattctgaaactaattgtgagtttgtgactcttggcttgcctgcagtgtccgcctgcaccttctataagtacagtcgcgagcctcagctatacaaaccaactagcgcatagtatctcctgagctccattcatcatcccaagtcttcactggtcttagatcacggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggtaggtaccgtagttagcttaatcacctagagctcgctatggatcaggatgtggatgtgttcgttcgatcgtttccacgtccaatctcgctgaataaattgtctcgagaaagtttggctttgccgagataaataatagtgataattcttactcctgctacaaactgttttccttgaagcaactatgagcatcttccatagattcgcgacacgatttaaattttaaaaataacatttttaaaaaaatgtgtcacggttacacaactttttttttaacactagttgcgccccgcgtccaagcttactccctgaaattgcattcaaactctcgattcatgtctgcccttctcaccttctgtgtgcctgtgtgggctcgacgtctagtcgtcttcgactcttcgcctacatcagtcacctcctcacacgacgtgtctgcgacacaggccgcggcatagagcacgggcatgtagttttgaacaagtgcatgttgctacctcgactatgatcatgcaaaatattttttttattatttatagaggtttaaaataagacatggaataataagcctggtggccttgaagctggaagtgtagcatggtggaagtgcgggtttgacaggccgacagcgcagagcatatcgaaaatacagctgaaaaaagatccgattatacttgaaaaaaaggataatcaccgaagcaatggaaagctccattcctgtttcccggtggaagaaaaatttctagcctccatccctgcgaacacataggagaactttttatcccttcaccgataaatttatgcccgcgagaaatctgcaaatacaataaatacaaattaattatattaaattaatataaattgaaaaacaagatttaaaattataatagatttctactttagagttcagttagctattttataattagttgtattgaaattttagtaaaattttaacatatcaataagctaaaagaagattatggaacaagtatacggggaattgggggtagaccggttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgcggccgcgaattctgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaggggcttcggaggatgttttagagctagaaatagcaagttaaaataaggctagtccgttatcaacttgaaaaagtggcaccgagtcggtgctttttttttgaattccaccggtgttaacggcaaacgctaattagtcactaggcccaggaaacactaactaagccctagcttatcctagcgcaacctagttaggtcttggttaccggcctagaaggccgatctcccgggcacccagctttcttgtacaaagtggccgttaacggatcggccagaatggcccggaccgaagctttgtacagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggcctcctccgagaacgtcatcaccgagttcatgcgcttcaaggtgcgcatggagggcaccgtgaacggccacgagttcgagatcgagggcgagggcgagggccgcccctacgagggccacaacaccgtgaagctgaaggtgaccaagggcggccccctgcccttcgcctgggacatcctgtccccccagttccagtacggctccaaggtgtacgtgaagcaccccgccgacatccccgactacaagaagctgtccttccccgagggcttcaagtgggagcgcgtgatgaacttcgaggacggcggcgtggcgaccgtgacccaggactcctccctgcaggacggctgcttcatctacaaggtgaagttcatcggcgtgaacttcccctccgacggccccgtgatgcagaagaagaccatgggctgggaggcctccaccgagcgcctgtacccccgcgacggcgtgctgaagggcgagacccacaaggccctgaagctgaaggacggcggccactacctggtggagttcaagtccatctacatggccaagaagcccgtgcagctgcccggctactactacgtggacgccaagctggacatcacctcccacaacgaggactacaccatcgtggagcagtacgagcgcaccgagggccgccaccacctgttcctgtagggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctagtatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggttgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcccgggcaactttattatacaaagttgatagataaatcagatatctggttcctaaggacccggcggaccgattaaactgattcggtccgacgcgttacctaataacttcgtatagcatacattatacgaagttattagctaactaactagtaagcttaagccatgggtcgacggatccgttacctgagctgattccgatgacttcgtaggttcctagctcaagccgctcgtgtccaagcgtcacttacgattagctaatgattacggcatctaggaccgactagctaactaactagtacgtacgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 402 - protein, 1501 aa, Artificial Sequence
  dCas9-NLS-CBF1a
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSSSQQQQQQQQQQQQQQQQQQQQQQQQQQQQQQTCAKDIQKAAAEAALAFQDETCDTTTTNHGLDMEETMVEAIYTPEQSEGAFYMDEETMFGMPTLLDNMAEGMLLPPPSVQWNHNYDGEGDGDVSLWSY

SEQ ID NO: 403 - DNA, 259 bp, Agrobacterium tumefaciens
tcgtaagagaataaaagcggcactgactaatgcaggtaggtttttccttttgagtattcgcaaccagtaacctttttctcggctgcgccgaaagattgccagcaaaacgctttgccgatgccgaagctgatctattttgccacacaactacaaatgaaactgaaaacttcttaataatctgcacccgcgtagcatatcatcctttcaaaagcacaggagcgatatcggatccatggcaccgaagaagaagcgcaaggtg

SEQ ID NO: 404 - DNA, 580 bp, Agrobacterium tumefaciens
agttgaggatgtttttcaggagactcgaccagggtaatcagcacgtctgttcggcgcgcctatagctatggtttctcgcaatcgctttgggcagtcggttgtggcggtgcgtcttctgagacccgaaggttggcgattatctgctggaggtcttcgataccgtcttcgaagaacaagacatatgttcgctgagctcggacataggatagtcggcataggcggataccctcgccacgcaaatggcgcgatcgacaccctgatcggagcctgcgaagtgccacagtttattggaaccatcccccgttcattccgccctggaatttcacttcgacggcattctagatcctcgccgttgtcttagagagccatctttcgtcggcgcacccttaagtgcatggaaagccgttttcgcttcaaatgaaatcgaaaagaagaaaacaaaaatcctagagtaaccgaccctcccgataatcgtgaacatcagatgacagcatttcttccgaccgaagtggctgtgttggttatgagcttggggagatggggagacggatccatggcaccgaagaagaagcgcaaggtg

SEQ ID NO: 405 - DNA, 1499 bp, Zea mays
gtgatctaagaccagtgaagacttgggatgatgaatggagctcaggagatactatgcgctagttggtttgtatagctgaggctcgcgactgtacttatagaaggtgcaggcggacactgcaggcaagccaagagtcacaaactcacaattagtttcagaatgtgtaaagccacgtttttaatctccctctctctaatggaaaataagtgggctttactgccacagtgacactaccgcactaatgtaaagttccaccgtgccatggagccacggcacttcaacggacacaacataagtcatgcctgctcattttccaaatttgtgtgttttgattttaacccccagggtgttttgcacgtcagttcgatttttaaccttgaactttaaaactgaataccgaacgagtcctccttactggttttcaaaggtcgttttttttaaaaaaaaacttgatagctaatttacaaggcatgcaaaaacaaatagttttcctttgtgcgaggaagtttaaatactactgtataatttacgggaccgagggactacaaggcatctcagcaagtcagagtcatttcctggtatatgtaccaagttcttctacatcaagtcagtgctcattgactaattatgtgtttggtttgagatcaaaataggatgagacggggataacaccgttctctcgatttttttggatcatgctgtcataaaaaattacttcggtgttcatctcgttctcgtgtgactctcatccaaatgttatagaaaatgtggccgccctctttgatcccttcttatacgtacaaccaaacacacgttaaaagatggattgaataattgaccgtgtataactgttataacacatgttctttaggcactgataattgcacaaacagaaaagacacgatcccctccgaggcaggcccaacccccagctcacagggtcacagctgtggattagactttgtacactgctgcccatgtctccagctaaactgaaaggttcacctgtacttgagtacttctgttggctggactttctaagatatagtgaaaccaagaatgtatctatgatctatcatgaaatgacaacattaccaggttcaaaattttgaacaagagaagaagctgctgtttgactcagcccgactactttagaacacatcattacatttggactaaacctaccagttctgatagccagattgtgccattctaggaatacgtctgatggtgcaccgagactttggagtacattcaacaagaggcccaacgaaacacttttgaaggctcaatctatagcctcatcagactatatacagacaatgcaaaaccacaaaactaataacagcgacacgggcaatgttaggtgcaaagaagtggcggcagaaacgtgaattgtgagaggaaacaaacaattgtcgacagatggatcgacagtagttatcaaacctaggccattgaagtagcaactatcctcactctgatcatctgctggtagt

SEQ ID NO: 406 - DNA, 18 bp, Zea mays
gaaggggcttcggaggat

SEQ ID NO: 407 - DNA, 18 bp, Zea mays
gtgatgcatccggacggg

SEQ ID NO: 408 - protein, 6 aa, Arabidopsis thaliana
LELRLN

SEQ ID NO: 409 - protein, 15 aa, Arabidopsis thaliana
TLPLFPTCGDDDDDD

SEQ ID NO: 410 - DNA, 29984 bp, Artificial Sequence
  PHP97202
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagagttacccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctacctgcgccaaggacatccagaaagcagccgccgaagcggccctcgccttccaagacgagacgtgcgatacaaccaccacgaatcatggcctcgatatggaggaaacgatggtcgaagccatctacaccccagagcagtcagaaggcgccttctacatggacgaggaaaccatgttcggcatgccgaccctcctcgacaacatggccgaaggaatgctcctcccacctccctcagttcagtggaaccacaactacgacggcgaaggcgacggagacgtttccctgtggagctactaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattccggtccgggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaactcaagccgctaccattaggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 411 - DNA, 33199 bp, Artificial Sequence
  PHP97330
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagagttacccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctacctgcgccaaggacatccagaaagcagccgccgaagcggccctcgccttccaagacgagacgtgcgatacaaccaccacgaatcatggcctcgatatggaggaaacgatggtcgaagccatctacaccccagagcagtcagaaggcgccttctacatggacgaggaaaccatgttcggcatgccgaccctcctcgacaacatggccgaaggaatgctcctcccacctccctcagttcagtggaaccacaactacgacggcgaaggcgacggagacgtttccctgtggagctactaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattccggtccgggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttcctagggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggatcactatctcgacattaggctgaggccagatcctgagtttccacctgctcagcttatgagcgttttgttcggtaagctccaccaggccctggtggcacagggcggagacagaattggtgttagcttcccagatcttgacgaaagccgtagcaggttgggcgagagactccgtattcacgctagcgccgatgacctgagggcacttttggctagaccttggctcgaaggactgcgtgatcaccttcagtttggtgagccagccgtggttcctcacccaaccccttacaggcaggtgagcagagttcaggcaaagagcaatccagaacgtttgaggagaaggctcatgcgtaggcacgacctgagcgaggaagaggctagaaagcgtattcctgataccgtggccagggcacttgacttgccattcgttaccctcagaagccagagcaccggccagcacttccgtctgtttattaggcacggacctcttcaggtgaccgctgaagagggtggcttcacctgctatggattgagcaagggtggcttcgttccatggttttgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgttcactgccgtataggcaggaaactcaagccgctaccattaggttttagagctagaaatagcaagttaaaataaggctagtccgttatcaacttgaaaaagtggcaccgagtcggtgctgttcactgccgtataggcaggtcgtatcacccatgggcaagttttagagctagaaatagcaagttaaaataaggctagtccgttatcaacttgaaaaagtggcaccgagtcggtgctgttcactgccgtataggcaggtagcctgtgcttgctaccccgttttagagctagaaatagcaagttaaaataaggctagtccgttatcaacttgaaaaagtggcaccgagtcggtgctgttcactgccgtataggcaggttcactgccgtataggcagttttttttgcggccgcgaattcctgcagggccctcttgtcggaccagttgcccaccacgttggtgaggggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 412 - DNA, 33317 bp, Artificial Sequence
  PHP97566
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagagttacccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctacctgcgccaaggacatccagaaagcagccgccgaagcggccctcgccttccaagacgagacgtgcgatacaaccaccacgaatcatggcctcgatatggaggaaacgatggtcgaagccatctacaccccagagcagtcagaaggcgccttctacatggacgaggaaaccatgttcggcatgccgaccctcctcgacaacatggccgaaggaatgctcctcccacctccctcagttcagtggaaccacaactacgacggcgaaggcgacggagacgtttccctgtggagctactaggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattccggtccgggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttcctagggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggatcactatctcgacattaggctgaggccagatcctgagtttccacctgctcagcttatgagcgttttgttcggtaagctccaccaggccctggtggcacagggcggagacagaattggtgttagcttcccagatcttgacgaaagccgtagcaggttgggcgagagactccgtattcacgctagcgccgatgacctgagggcacttttggctagaccttggctcgaaggactgcgtgatcaccttcagtttggtgagccagccgtggttcctcacccaaccccttacaggcaggtgagcagagttcaggcaaagagcaatccagaacgtttgaggagaaggctcatgcgtaggcacgacctgagcgaggaagaggctagaaagcgtattcctgataccgtggccagggcacttgacttgccattcgttaccctcagaagccagagcaccggccagcacttccgtctgtttattaggcacggacctcttcaggtgaccgctgaagagggtggcttcacctgctatggattgagcaagggtggcttcgttccatggttttgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgttcactgccgtataggcaggaaactcaagccgctaccattaggttttagagctagaaatagcaagttaaaataaggctagtccgttatcaacttgaaaaagtggcaccgagtcggtgctgttcactgccgtataggcaggtcgtatcacccatgggcaagttttagagctagaaatagcaagttaaaataaggctagtccgttatcaacttgaaaaagtggcaccgagtcggtgctgttcactgccgtataggcaggtagcctgtgcttgctaccccgttttagagctagaaatagcaagttaaaataaggctagtccgttatcaacttgaaaaagtggcaccgagtcggtgctgttcactgccgtataggcaggcccctgcctgttctgcacgcgttttagagctagaaatagcaagttaaaataaggctagtccgttatcaacttgaaaaagtggcaccgagtcggtgctgttcactgccgtataggcaggttcactgccgtataggcagttttttttgcggccgcgaattcctgcagggccctcttgtcggaccagttgcccaccacgttggtgaggggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 413 - DNA, 31055 bp, Artificial Sequence
  PHP97203
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagagttacccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctgcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcataggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattccggtccgggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgaaactcaagccgctaccattaggttttagagctagaaatagcaagttaaaataaggctagtccgttatcaacttgaaaaagtggcaccgagtcggtgctttttttttgcggccgcgaattcctgcagggccctcttgtcggaccagttgcccaccacgttggtgaggggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 414 - DNA, 34270 bp, Artificial Sequence
  PHP97388
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagagttacccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctgcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcataggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattccggtccgggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttcctagggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggatcactatctcgacattaggctgaggccagatcctgagtttccacctgctcagcttatgagcgttttgttcggtaagctccaccaggccctggtggcacagggcggagacagaattggtgttagcttcccagatcttgacgaaagccgtagcaggttgggcgagagactccgtattcacgctagcgccgatgacctgagggcacttttggctagaccttggctcgaaggactgcgtgatcaccttcagtttggtgagccagccgtggttcctcacccaaccccttacaggcaggtgagcagagttcaggcaaagagcaatccagaacgtttgaggagaaggctcatgcgtaggcacgacctgagcgaggaagaggctagaaagcgtattcctgataccgtggccagggcacttgacttgccattcgttaccctcagaagccagagcaccggccagcacttccgtctgtttattaggcacggacctcttcaggtgaccgctgaagagggtggcttcacctgctatggattgagcaagggtggcttcgttccatggttttgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgttcactgccgtataggcaggaaactcaagccgctaccattaggttttagagctagaaatagcaagttaaaataaggctagtccgttatcaacttgaaaaagtggcaccgagtcggtgctgttcactgccgtataggcaggtcgtatcacccatgggcaagttttagagctagaaatagcaagttaaaataaggctagtccgttatcaacttgaaaaagtggcaccgagtcggtgctgttcactgccgtataggcaggtagcctgtgcttgctaccccgttttagagctagaaatagcaagttaaaataaggctagtccgttatcaacttgaaaaagtggcaccgagtcggtgctgttcactgccgtataggcaggttcactgccgtataggcagttttttttgcggccgcgaattcctgcagggccctcttgtcggaccagttgcccaccacgttggtgaggggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 415 - DNA, 34388 bp, Artificial Sequence
  PHP97331
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgggttaccgaattcgagctcggtaccctgggatccgatatcgatgggccctggccgaagcttggtcacccggtccgggcctagaaggccagcttcaagtttgtacaaaaaagcaggctccggccagagttacccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggcaccgaagaagaagcgcaaggtgatggacaagaagtacagcatcggcctcgacatcggcaccaactcggtgggctgggccgtcatcacggacgaatataaggtcccgtcgaagaagttcaaggtcctcggcaatacagaccgccacagcatcaagaaaaacttgatcggcgccctcctgttcgatagcggcgagaccgcggaggcgaccaggctcaagaggaccgccaggagacggtacactaggcgcaagaacaggatctgctacctgcaggagatcttcagcaacgagatggcgaaggtggacgactccttcttccaccgcctggaggaatcattcctggtggaggaggacaagaagcatgagcggcacccaatcttcggcaacatcgtcgacgaggtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgtgcaggtggcctaccacgagaagtacccgacaatctaccacctccggaagaaactggtggacagcacagacaaggcggacctccggctcatctaccttgccctcgcgcatatgatcaagttccgcggccacttcctcatcgagggcgacctgaacccggacaactccgacgtggacaagctgttcatccagctcgtgcagacgtacaatcaactgttcgaggagaaccccataaacgctagcggcgtggacgccaaggccatcctctcggccaggctctcgaaatcaagaaggctggagaaccttatcgcgcagttgccaggcgaaaagaagaacggcctcttcggcaaccttattgcgctcagcctcggcctgacgccgaacttcaaatcaaacttcgacctcgcggaggacgccaagctccagctctcaaaggacacctacgacgacgacctcgacaacctcctggcccagataggagaccagtacgcggacctcttcctcgccgccaagaacctctccgacgctatcctgctcagcgacatccttcgggtcaacaccgaaattaccaaggcaccgctgtccgccagcatgattaaacgctacgacgagcaccatcaggacctcacgctgctcaaggcactcgtccgccagcagctccccgagaagtacaaggagatcttcttcgaccaatcaaaaaacggctacgcgggatatatcgacggcggtgccagccaggaagagttctacaagttcatcaaaccaatcctggagaagatggacggcaccgaggagttgctggtcaagctcaacagggaggacctcctcaggaagcagaggaccttcgacaacggctccatcccgcatcagatccacctgggcgaactgcatgccatcctgcggcgccaggaggacttctacccgttcctgaaggataaccgggagaagatcgagaagatcttgacgttccgcatcccatactacgtgggcccgctggctcgcggcaactcccggttcgcctggatgacccggaagtcggaggagaccatcacaccctggaactttgaggaggtggtcgataagggcgctagcgctcagagcttcatcgagcgcatgaccaacttcgataaaaacctgcccaatgaaaaagtcctccccaagcactcgctgctctacgagtacttcaccgtgtacaacgagctcaccaaggtcaaatacgtcaccgagggcatgcggaagccggcgttcctgagcggcgagcagaagaaggcgatagtggacctcctcttcaagaccaacaggaaggtgaccgtgaagcaattaaaagaggactacttcaagaaaatagagtgcttcgactccgtggagatctcgggcgtggaggatcggttcaacgcctcactcggcacgtatcacgacctcctcaagatcattaaagacaaggacttcctcgacaacgaggagaacgaggacatcctcgaggacatcgtcctcaccctgaccctgttcgaggaccgcgaaatgatcgaggagaggctgaagacctacgcgcacctgttcgacgacaaggtcatgaaacagctcaagaggcgccgctacactggttggggaaggctgtcccgcaagctcattaatggcatcagggacaagcagagcggcaagaccatcctggacttcctcaagtccgacgggttcgccaaccgcaacttcatgcagctcattcacgacgactcgctcacgttcaaggaagacatccagaaggcacaggtgagcgggcagggtgactccctccacgaacacatcgccaacctggccggctcgccggccattaaaaagggcatcctgcagacggtcaaggtcgtcgacgagctcgtgaaggtgatgggccggcacaagcccgaaaatatcgtcatagagatggccagggagaaccagaccacccaaaaagggcagaagaactcgcgcgagcggatgaaacggatcgaggagggcattaaagagctcgggtcccagatcctgaaggagcaccccgtggaaaatacccagctccagaatgaaaagctctacctctactacctgcagaacggccgcgacatgtacgtggaccaggagctggacattaatcggctatcggactacgacgtcgaccacatcgtgccgcagtcgttcctcaaggacgatagcatcgacaacaaggtgctcacccggtcggataaaaatcggggcaagagcgacaacgtgcccagcgaggaggtcgtgaagaagatgaaaaactactggcgccagctcctcaacgcgaaactgatcacccagcgcaagttcgacaacctgacgaaggcggaacgcggtggcttgagcgaactcgataaggcgggcttcataaaaaggcagctggtcgagacgcgccagatcacgaagcatgtcgcccagatcctggacagccgcatgaatactaagtacgatgaaaacgacaagctgatccgggaggtgaaggtgatcacgctgaagtccaagctcgtgtcggacttccgcaaggacttccagttctacaaggtccgcgagatcaacaactaccaccacgcccacgacgcctacctgaatgcggtggtcgggaccgccctgatcaagaagtacccgaagctggagtcggagttcgtgtacggcgactacaaggtctacgacgtgcgcaaaatgatcgccaagtccgagcaggagatcggcaaggccacggcaaaatacttcttctactcgaacatcatgaacttcttcaagaccgagatcaccctcgcgaacggcgagatccgcaagcgcccgctcatcgaaaccaacggcgagacgggcgagatcgtctgggataagggccgggatttcgcgacggtccgcaaggtgctctccatgccgcaagtcaatatcgtgaaaaagacggaggtccagacgggcgggttcagcaaggagtccatcctcccgaagcgcaactccgacaagctcatcgcgaggaagaaggattgggacccgaaaaaatatggcggcttcgacagcccgaccgtcgcatacagcgtcctcgtcgtggcgaaggtggagaagggcaagtcaaagaagctcaagtccgtgaaggagctgctcgggatcacgattatggagcggtcctccttcgagaagaacccgatcgacttcctagaggccaagggatataaggaggtcaagaaggacctgattattaaactgccgaagtactcgctcttcgagctggaaaacggccgcaagaggatgctcgcctccgcaggcgagttgcagaagggcaacgagctcgccctcccgagcaaatacgtcaatttcctgtacctcgctagccactatgaaaagctcaagggcagcccggaggacaacgagcagaagcagctcttcgtggagcagcacaagcattacctggacgagatcatcgagcagatcagcgagttctcgaagcgggtgatcctcgccgacgcgaacctggacaaggtgctgtcggcatataacaagcaccgcgacaaaccaatacgcgagcaggccgaaaatatcatccacctcttcaccctcaccaacctcggcgctccggcagccttcaagtacttcgacaccacgattgaccggaagcggtacacgagcacgaaggaggtgctcgatgcgacgctgatccaccagagcatcacagggctctatgaaacacgcatcgacctgagccagctgggcggagacaagagaccacgggaccgccacgatggcgagctgggaggccgcaagcgggcaaggggaggatccagctcccaacagcaacaacagcagcaacagcagcagcagcagcagcaacagcaacagcaacagcagcagcagcagcagcagcaacagcagcaacaaggcgcgcctgcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccatttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagaggaattcctgcatacattttcgaaggaatgtgaatatatcagaactgcagtgacaaatggtagtgccattaagcatgatggctcatatgaatcagatcctgcagttgagattgttcgagttgaactccaaggtgctgctgcatttctttattctcgtctggtacctcttgttcttcttctggttgaaggttccacgcctatagatattggagaacatggatgggaaatgcttctggtagtaaagaaggcaacacaagaggctggttcaaaatttgaactgctaggttttgcagctgtgcataacttctatcattatcctgagagtattcgcttacgaatcagccagatacttgtgttgccaccttatcagggtgaaggccatggtcttggtcttcttgaagcaatcaattatattgcacagtctgagaacatttacgatgttacaatagaaagcccttctgattacctgcagtatgtgcgatcatccattgactgcctccgtttgctcatgtttgatccgatcaaacctgcactcggtgctattgtcttgtctctgaaggagaccaacctgtcaaaaagggcccaaagtttgagaatggttccaccagctgacctgatggagactgtccgtcagaagctgaagataaacaagaaacagttcctccggtgctgggaaattctgatcttcctaagcctcgactctcaggatcataagagcatggacaacttcagggcctgcatatatgaccgcatgaagggggagatccttggcagtgcctctggaactaacaggaagcgtctgttgcagatgccaaccagtttcaataaggaggcatcttttgctgtgtattggacacaggagattgaggatgaggatgaacaaactgttgagcagcagccagaggatctcaagacgcaggagcaacagctcaatgagctcgtggacatccaaatcgaggagattgctggggtcgccaagaacgtcacttcataggcggccgcaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattccggtccgggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttcctagggtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctcccccccccccctctctaccttctctagatcggcgttccggtccatgcatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcaggtcgactttaacttagcctaggatccatggatcactatctcgacattaggctgaggccagatcctgagtttccacctgctcagcttatgagcgttttgttcggtaagctccaccaggccctggtggcacagggcggagacagaattggtgttagcttcccagatcttgacgaaagccgtagcaggttgggcgagagactccgtattcacgctagcgccgatgacctgagggcacttttggctagaccttggctcgaaggactgcgtgatcaccttcagtttggtgagccagccgtggttcctcacccaaccccttacaggcaggtgagcagagttcaggcaaagagcaatccagaacgtttgaggagaaggctcatgcgtaggcacgacctgagcgaggaagaggctagaaagcgtattcctgataccgtggccagggcacttgacttgccattcgttaccctcagaagccagagcaccggccagcacttccgtctgtttattaggcacggacctcttcaggtgaccgctgaagagggtggcttcacctgctatggattgagcaagggtggcttcgttccatggttttgaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcaagctttgagagtacaatgatgaacctagattaatcaatgccaaagtctgaaaaatgcaccctcagtctatgatccagaaaatcaagattgcttgaggccctgttcggttgttccggattagagccccggattaattcctagccggattacttctctaatttatatagattttgatgagctggaatgaatcctggcttattccggtacaaccgaacaggccctgaaggataccagtaatcgctgagctaaattggcatgctgtcagagtgtcagtattgcagcaaggtagtgagataaccggcatcatggtgccagtttgatggcaccattagggttagagatggtggccatgggcgcatgtcctggccaactttgtatgatatatggcagggtgaataggaaagtaaaattgtattgtaaaaagggatttcttctgtttgttagcgcatgtacaaggaatgcaagttttgagcgagggggcatcaaagatctggctgtgtttccagctgtttttgttagccccatcgaatccttgacataatgatcccgcttaaataagcaacctcgcttgtatagttccttgtgctctaacacacgatgatgataagtcgtaaaatagtggtgtccaaagaatttccaggcccagttgtaaaagctaaaatgctattcgaatttctactagcagtaagtcgtgtttagaaattatttttttatataccttttttccttctatgtacagtaggacacagtgtcagcgccgcgttgacggagaatatttgcaaaaaagtaaaagagaaagtcatagcggcgtatgtgccaaaaacttcgtcacagagagggccataagaaacatggcccacggcccaatacgaagcaccgcgacgaagcccaaacagcagtccgtaggtggagcaaagcgctgggtaatacgcaaacgttttgtcccaccttgactaatcacaagagtggagcgtaccttataaaccgagccgcaagcaccgaattgttcactgccgtataggcaggaaactcaagccgctaccattaggttttagagctagaaatagcaagttaaaataaggctagtccgttatcaacttgaaaaagtggcaccgagtcggtgctgttcactgccgtataggcaggtcgtatcacccatgggcaagttttagagctagaaatagcaagttaaaataaggctagtccgttatcaacttgaaaaagtggcaccgagtcggtgctgttcactgccgtataggcaggtagcctgtgcttgctaccccgttttagagctagaaatagcaagttaaaataaggctagtccgttatcaacttgaaaaagtggcaccgagtcggtgctgttcactgccgtataggcaggcccctgcctgttctgcacgcgttttagagctagaaatagcaagttaaaataaggctagtccgttatcaacttgaaaaagtggcaccgagtcggtgctgttcactgccgtataggcaggttcactgccgtataggcagttttttttgcggccgcgaattcctgcagggccctcttgtcggaccagttgcccaccacgttggtgaggggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 416 - DNA, 26227 bp, Artificial Sequence
  PHP94831
gtttacccgccaatatatcctgtcaaacactgatagtttaaactgaaggcgggaaacgacaatctgatcatgagcggagaattaagggagtcacgttatgacccccgccgatgacgcgggacaagccgttttacgtttggaactgacagaaccgcaacgttgaaggagccactcagcaagctggtacgattgtaatacgactcactatagggcgaattgagcgctgtttaaacgctcttcaactggaagagcggttacgctgtttaaacgctcttcaactggaagagcggttactaccggttcactagctagctgctaatcgagctagttaccctatgaggtgacatgaagcgctcacggttactatgacggttagcttcacgactgttggtggcagtagcgtacgacttagctatagttccggacttacccttaagcgatttaaatctgcggttaccgaattcgagctcggtaccctgggatctgcccttactttaacgcctctaaccaacacccctttatctttataaggaacaataaacagaatttgccccactgttctaaatcacctaataatatccccagctaaaaacaataaaggtttcctagaattaagacaagcatgactgttcctccaggagggtttggaacattgttgcagtcttgcagatacgggcgaagggtgagaaacagagcggagggctggaggtgacctcggtagtcgacgccggagttgagcttgacaacgacggggcggcccctgatggacttgaggaagtccgatggcgtcttcaccgtcccgccggcgcccgaggcgggcctgtcgctgccgccgccgccgctgctcatcttgcgcgctgtgcccccggcggtgtccctgtgttgcggatcgcgggtgggccaggtggatgcgagggcgacccgtttggactccggccggagccgccggatccctggtcggtgtcagtgccgtttactctgggccccacgtgtcagtaccgtctgtagatgacaacaacccgtcgtccacagtcatgtccaaaatatcctttcttcttttttttcgattcggatatctatcttccttttttttttccaaaaatcttcttgacgcaccagcgcgcacgtttgtggtaaacgccgacacgtcggtcccacgtcgatagaccccacccaccagtgagtagcgtgtacgtattcgggggtgacggacgtgtcgccgtcgtcttgctagtcccattcccatctgagccacacatctctgaacaaaaaaaaggagggaggcctccacgcacatccccctccgtgccacccgccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggtgctcagcggcgtcacccgccatgccgatggctcccccggccaccccgctccggccgtggggccccaccgagccccgcaagggtgctgacatcctcgtcgagtccctcgagcgctgcggcgtccgcgacgtaagtttctgcttctacctttgatatatatataataattatcattaattagtagtaatataatatttcaaatatttttttcaaaataaaagaatgtagtatatagcaattgcttttctgtagtttataacttcgtatagcatacattatacgaagttatacttttctaatatatgaccaaaatttgttaccgaattcaggcgacccatcgctgctttgtctacatcatgttcttcatcatcctccccaggcgacgcgtgctgctgttcttattcagactaccgttcgagtgactgcatggcgtacatctttctgcatcgactttgtacggctacatcgaacatatacacgagatgtctcgtgtgaatagagtcactaatgccttaagcatcggttactccgtagggtacattctgttcttcttatttgtgcatatttttattgttgtttactgattatacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtacgactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgactggggactctatcagtgatagagtctagaggatcgctcaggaaggccgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccgccttcaggcgcggcgcctccctcgcccaccctcggcttctacgccgccggcaatggcggcggatcggctgtgctgctggacacgagttccgactggggcagcagcggcgctgccatggccaccgagacatgcttcctgcaggactacatgggcgtgacggacacgggcagctcgtcgcagtggccacgcttctcgtcgtcggacacgataatggcggcggccgcggcgcgggcggcgacgacgcgggcgcccgagacgctccctctcttcccgacctgcggcgacgacggcggcagcggtagcagcagctacttgccgttctggggtgccgcgtccacaactgccggcgccacttcttccgttgcgatccagcagcaacaccagctgcaggagcagtacagcttttacagcaacagcaacagcacccagctggccggcaccggcaaccaagacgtatcggcaacagcagcagcagccgccgccctggagctgagcctcagctcatggtgctccccttaccctgctgcagggagtatgtgagagcaacgcgagctgccactgctcttcactggtaccgttaacagatcattcgacaaagcagcattagtccgttgatcggtggaagaccactcgtcagtgttgagttgaatgtttgatcaataaaatacggcaatgctgtaagggttgttttttatgccattgataatacactgtactgttcagttgttgaactctatttcttagccatgccaagtgcttttcttattttgaataacattacagcaaaaagttgaaagacaaaaaaaaaaacccccgaacagagtgctttgggtcccaagcttctttagactgtgttcggcgttccccctaaatttctccccctatatctcactcacttgtcacatcagcgttctctttccccctatatctccacgctctacagcagttccacctatatcaaacctctataccccaccacaacaatattatatactttcatcttcaactaactcatgtaccttccaatttttttctactaataattatttacgtgcacagaaacttagcaaggagagagagagcggggtgacccaccttgctagttggatattacctcttctcttcaaagtatccttgaacgctcaccggttatcaaatctctacactatagctctgtagtcttgctagatagttagttctttagctctcggtgaccaagcttggcgcgatcaagcttatcgataccgtcgacctcgaagcttggtcacccggtccgggcctagaaggccagcttcaagtttgtacaaaaaagcaggctccggccagaatggcccggaccgggttaccgaattcttaccctagctccctgcggctgttacgcggtcccccatcaatcttctgttcttgcggttgtagcctgtgtaacagtgctagagtatgtatgataaataggttttaagtctgcttacatgacattttttattgtggaagagacatataaaaattagagagagtggttctcatgcaacggcggacggcccggtgctaaaagagcttcaagacaaaataatgaaacaggaagagagtagatttatctaagagccaactttattatatgaatgtgtttattgttggctttagatgatatggtaaggagttagagctaataatagataggctctattattattattattaattaaactcgctctaaggaggaaagtgggaggaagggacgaggacgaagactactggaagcatcgtgcatggatgatggatgtggtgtctcttaatgtaggtggccggaggatgtacgtgttaattgcgcgataagcactcagatccaaccgcaaactacctccacactgacacactgatagagagaaagagagacctccgacgactgccgccgcagatgagccacgtacgtatacgacgtctgccggccggctcaggctgccgccatcaccctgctcgaaagtcgcgttaggcggcgccagctacataggagtatctagtctagccagttagtatactactactgcgctgatgatgaattaactctgcatagatactgtacttgcctccctccaacacccaaccacctcctgctcggctcttaataacttggacacggatcgatgccatccaaggaagaacacgacgacgacgacggaacatccaccatgcaagcttgcatccatacgccgatacgcgtgcatccatccatccaccattatttccattttccaccgatcacacgtacacaggcctatttaaggagcgacatcccactgcaactctcctcaccactcatcaccagctagctctagcaaagcacttgccatctaccgaccgccgcattccaaacagcccgacgagctagcagagcggcaggcacctccctcctcaaggaacccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcttcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcgggcatggcggcgcgcagctcttcagtgtctggaacgacacttaagcgtacctagtggtacctgacatcttatagtctgcaacctctcgtgtctgaattcctatctttatcaagtgttattgcttccacgactataggacagctttcgtcgaaagcttttgctcatgtgatctcgaaggattcatctagtctgatttttcgtgacttgtatcggttttattggattcatccaacatatatcaataaaaaatgagttgtgtttcctttcttcctagttcagttaaaattatttccctcctgcgcttgtgctgtaattgtctgtgtacctgttgtttgtgactgtgttagttcccttggatatgatttcgtatttgatatgtacatggagatagcttagcttcattattggagtatgaagttagtatgacatagtcactctcctggaaaattgacactgcaaaccatatttttattctgaaccacaaatcctagtcagtccgctggcatatgccgtccgtttgctgaatccagaacgtgggtttggagatgtacggctgagatgcctctatgcgaaggggatttcgtggtgaaacgagatgggagtagagcaacgcccgtggaagatgcttcaaacttccacacttttgagcaacgatcggcagtagtaaggtagacgatttcaagatcaaagcatatgaagataaacaacatcaacaacaaaatttgttggggttctatagagagaaacagagctacatacatacactgttttgtatctaccatctgagatgatgaaaagatgaaaaactaaagaatgccccggcgccaacgccaggacacgccgcgcgcgcgtcacccgagccatctcttgacccagccggcgctgtatatttacacacgttgcagcatcgatcaccacctgttcgatcgcgtcgccgtcaccgggatctgagtcgaaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcgaccttcttatgtgcttctagtctccaaatgtggttgatagttattttgctctaagatcaacagtaatgaagtataaatcatcgttgtggtgtgctactcggttaattgagcattaacacacacaaacatgacgaggatggtataatctccaaaaatgtgtactttgttaggtgggaccctatagccttgattaatgtgctatgttaggcatgcctggaaacgtgtgacgcatatgttttgtgaacctgttgatattatatgtgcttttatattaccatattttattaaaatactaatatttattactagtaagatataacattctatctagcttaaaaactaaccataaatattccataataactagatttaccaaactaatatactaaatatacataataaatacaaaattaacaagacaataatcaatatttatgagcttaatatatttagacattatggttggtcgacgataatcatgctaacttttcgtaattgcttgattgaaatatgcttagaataatgcctctttgttctacatggcaaatagggaccattatggtgtaacaccctgggaaccacaaacaccccgaaatgctactaaactacacaactaaccttcatatataaaatttcgacagcatctcctttgaaaatttgcatagacgtggaagcaacagagtataaacagatatcatgataagaaaacatactagacattaataatctgctagaaatgggaagaatcctaacttgacgactgcgtaactgactagagtcacacttagctgaccctagtcacttacaactgacttcgtgtcctagatcgatgggccctggccgaagcttggtcacccggtccgggcctagaaggccagcttcaagtttgtaccctggagcttgccgagtgccatccttggacactcgataaagtatattttattttttttattttgccaaccaaactttttgtggtatgttcctacactatgtagatctacatgtaccattttggcacaattacatatttacaaaaatgttttctataaatattagatttagttcgtttatttgaatttcttcggaaaattcacatttaaactgcaagtcactcgaaacatggaaaaccgtgcatgcaaaataaatgatatgcatgttatctagcacaagttacgaccgatttcagaagcagaccagaatcttcaagcaccatgctcactaaacatgaccgtgaacttgttatctagttgtttaaaaattgtataaaacacaaataaagtcagaaattaatgaaacttgtccacatgtcatgatatcatatatagaggttgtgataaaaatttgataatgtttcggtaaagttgtgacgtactatgtgtagaaacctaagtgacctacacataaaatcatagagtttcaatgtagttcactcgacaaagactttgtcaagtgtccgataaaaagtactcgacaaagaagccgttgtcgatgtactgttcgtcgagatctctttgtcgagtgtcacactaggcaaagtctttacggagtgtttttcaggctttgacactcggcaaagcgctcgattccagtagtgacagtaatttgcatcaaaaatagctgagagatttaggccccgtttcaatctcacgggataaagtttagcttcctgctaaactttagctatatgaattgaagtgctaaagtttagtttcaattaccaccattagctctcctgtttagattacaaatggctaaaagtagctaaaaaatagctgctaaagtttatctcgcgagattgaaacagggccttaaaatgagtcaactaatagaccaactaattattagctattagtcgttagcttctttaatctaagctaaaaccaactaatagcttatttgttgaattacaattagctcaacggaattctctgtttttctaaaaaaaaactgcccctctcttacagcaaattgtccgctgcccgtcgtccagatacaatgaacgtacctagtaggaactcttttacacgctcggtcgctcgccgcggatcggagtccccggaacacgacaccactgtggaacacgacaaagtctgctcagaggcggccacaccctggcgtgcaccgagccggagcccggataagcacggtaaggagagtacggcgggacgtggcgacccgtgtgtctgctgccacgcagccttcctccacgtagccgcgcggccgcgccacgtaccagggcccggcgctggtataaatgcgcgccacctccgctttagttctgcatacagccaacccaaggatgtccaacctgctcacggttcaccagaaccttccggctcttccagtggacgcgacgtccgatgaagtcaggaagaacctcatggacatgttccgcgacaggcaagcgttcagcgagcacacctggaagatgctgctctccgtctgccgctcctgggctgcatggtgcaagctgaacaacaggaagtggttccccgctgagcccgaggacgtgagggattaccttctgtacctgcaagcgcgaggtttgtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaacatggtgatgcctaggtctggcagtgaagaccatccagcaacaccttggacaactgaacatgcttcacaggcgctccggcctcccgcgccccagcgactcgaacgccgtgagcctcgtcatgcgccgcatcaggaaggaaaacgtcgatgccggcgaaagggcaaagcaggccctcgcgttcgagaggaccgatttcgaccaggtccgcagcctgatggagaacagcgacaggtgccaggacattaggaacctggcgttcctcggaattgcatacaacacgctcctcaggatcgcggaaattgcccgcattcgcgtgaaggacattagccgcaccgacggcggcaggatgcttatccacattggcaggaccaagacgctcgtttccaccgcaggcgtcgaaaaggccctcagcctcggagtgaccaagctcgtcgaacgctggatctccgtgtccggcgtcgcggacgacccaaacaactacctcttctgccgcgtccgcaagaacggggtggctgcccctagcgccaccagccaactcagcacgagggccttggaaggtattttcgaggccacccaccgcctgatctacggcgcgaaggatgacagcggtcaacgctacctcgcatggtccgggcactccgcccgcgttggagctgctagggacatggcccgcgccggtgtttccatccccgaaatcatgcaggcgggtggatggacgaacgtgaacattgtcatgaactacattcgcaaccttgacagcgagacgggcgcaatggttcgcctcctggaagatggtgactgagctagacccagctttcttgtacaaagtggccgttaacggatccagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaattgcggcaagctgttaccgaattcctgcccttaaggccaattgttcaagattcattcaacaattgaaacatctcccatgattaaatcagtataaggttgctatggtcttgcttgacaaagtttttttttgagggaatttcaactaaatttttgagtgaaactatcaaatactgattttaaaaaatttttataaaaggaagcgcagagataaaaggccatctatgctacaaaagtacccaaaaatgtaatcctaaagtatgaattgcattttttttttgtttggacgaaaggaaaggagtattaccacaagaatgatatcatcttcatatttagatcttttttgggtaaagcttgagattctctaaatatagagaaatcagaagaaaaaaaaaccgtgttttggtggttttgatttctagcctccacaataactttgacggcgtcgacaagtctaacggacaccaagcagcgaaccaccagcgccgagccaagcgaagcagacggccgagacgttgacaccttcggcgcggcatctctcgagagttccgctccggcgctccacctccaccgctggcggtttcttattccgttccgttccgcctcctgctctgctcctctccacaccacacggcacgaaaccgttacggcaccggcagcacccagcacgggagaggggattcctttcccaccgttccttccctttccgccccgccgctataaatagccagccccatccccagcttttttccccaatctcatctcctctctcctgttgttcggagcacacgcacaatccgatcgatccccaaatccccttcgtctctcctcgcgagcctcgtggatcccagcttcaaggtacggcgatcgatcatcccccctccttctctctaccttcttttctctagactacatcggatggcgatccatggttagggcctgctagtttcccttcctgttttgtcgatggctgcgaggcacaatagatctgatggcgttatgacggctaacttgtcatgttgttgcgatttatagtccctttaggagatcagtttaatttctcggatggttcgagatcggtggtccatggttagtaccctaagatccgcgctgttagggttcgtagatggaggcgacctgttctgattgttaacttgtcagtacctgggaaatcctgggatggttctagctcgtccgcagatgagatcgatttcatgatcctctgtatcttgtttcgttgcctaggttccgtctaatctatccgtggtatgatgtagatgttttgatcgtgctaactacgtcttgtaaagttaattgtcaggtcataatttttagcatgcctttttttttgtttggttttgtctaattgggctgtcgttctagatcagagtagaagactgttccaaactacctgctggatttattgaacttggatctgtatgtgtgtcacatatcttcataaattcatgattaagatggattgaaatatcttttatctttttggtatggatagttctatatgttggtgtggctttgttagatgtatacatgcttagatacatgaagcaacgtgctgctactgtttagtaattgctgttcatttgtctaataaacagataaggatatgtatttatgttgctgttggttttgctggtactttgttggatacaaatgcttcaatacagaaaacagcatgctgctacgatttaccatttatctaatcttatcatatgtctaatctaataaacaaacatgcttttaaattatcttcatatgcttggatgatggcatacacagcggctatgtgtggttttttaaatacccagcatcatgggcatgcatgacactgctttaatatgctttttatttgcttgagactgtttcttttgtttatactgaccctttagttcggtgactcttctgcaggtcgactttaacttagcctaggatccatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgccggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgccctccggactcagatctcgatagggtaccaatggccagttaacagatccagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaaaccaaatctattctgaacttttgaagatctgtgatgtccggaagaaaagattcaaacagataaacgggactctccagaatctataaaataaatgatcgacaaacgctttgctttggtaggcttcctagttagttagcggaccgaagcttcggtccgggcctagaaggccagcttcggccgccccatttcaaatatttttttcaaaataaaagaatgtagtatatagcaattgcttttctgtagtttataacttcgtatagcatacattatacgaagttatacttttctaatatatgaccaaaatttgttgatgtgcaggtcttcgcctaccccggcggcgcgtccatggagatccaccaggcactcacccgctcccccgtcatcgccaaccacctcttccgccacgagcaaggggaggcctttgccgcctccggctacgcgcgctcctcgggccgcgtcggcgtctgcatcgccacctccggccccggcgccaccaacctagtctccgcgctcgccgacgcgctgctcgattccgtccccatggtcgccatcacgggacaggtggcgcgacgcatgattggcaccgacgccttccaggagacgcccatcgtcgaggtcacccgctccatcaccaagcacaactacctggtcctcgacgtcgacgacatcccccgcgtcgtgcaggaggctttcttcctcgcctcctctggtcgaccagggccggtgcttgtcgacatccccaaggacatccagcagcagatggcggtgcctgtctgggacaagcccatgagtctgcctgggtacattgcgcgccttcccaagccccctgcgactgagttgcttgagcaggtgctgcgtcttgttggtgaatcgcggcgccctgttctttatgtgggcggtggctgcgcagcatctggtgaggagttgcgacgctttgtggagctgactggaatcccggtcacaactactcttatgggcctcggcaacttccccagcgacgacccactgtctctgcgcatgctaggtatgcatgggacggtgtatgcaaattatgcagtggataaggccgatctgttgcttgcacttggtgtgcggtttgatgatcgcgtgacagggaagattgaggcttttgcaagcagggctaagattgtgcacgttgatattgatccggctgagattggcaagaacaagcagccacatgtgtccatctgtgcagatgttaagcttgctttgcagggcatgaatgctcttcttgaaggaagcacatcaaagaagagctttgactttggctcatggaacgatgagttggatcagcagaagagggaattcccccttgggtataaaacatctaatgaggagatccagccacaatatgctattcaggttcttgatgagctgacgaaaggcgaggccatcatcggcacaggtgttgggcagcaccagatgtgggcggcacagtactacacttacaagcggccaaggcagtggttgtcttcagctggtcttggggctatgggatttggtttgccggctgctgctggtgcttctgtggcaaacccaggtgtcactgttgttgacatcgatggagatggtagctttctcatgaacgttcaggagctagctatgatccgaattgagaacctcccagtgaaggtctttgtgctaaacaaccagcacctggggatggtggtgcagttggaggacaggttctataaggccaacagagcgcacacatacttgggaaacccagagaatgaaagtgagatatatccagatttcgtgacgatcgccaaagggttcaacattccagcggtccgtgtgacaaagaagaacgaagtccgcgcagcgataaagaagatgctcgagactccagggccgtacctcttggatataatcgtcccacaccaggagcatgtgttgcctatgatccctagtggtggggctttcaaggatatgatcctggatggtgatggcaggactgtgtactgatgactagctagtcagttaacagatctgccagatcctcggtgtacaaataacccgtcttatcctatgagacgggccggcgtcagtgtgttctggaggaatttttatgtcagagcctttttctttgtgtgcttgatgtagatgccaagggaagcttattggctgttgaagcttgatgcaaaataaattatggaactctgttttttgtttatctaataataactagcaaatatgcttccattgcattgaaactaacagccttttgtgtttccaagttttattttgtgacaatgtcatctatttcaattagttgtggaatcggaaacttgcaggactaacttggaaactccaatccctcagcatcctggactttttcctggtgtaatccatgtagatattattttaatcatcattttagttctggaggtttttccatctccggttttgctcccctttcttcaaaaaaaaaaaaaaaatgccgtaggcgccgcaacgcccacctgttgttcaaactcatgggcacgagtggctcgaagattttatacaacaattgctgtagtttcaccgttgctggtgaagaagcatttttttaaaaaaatatagtggtattcattttaattagtttagttgtgcagcgagcaaaatttggacatgctctgctcggaatctgatcgacctagacacagattagcagcagtagctttgtcatctgttccaagagttgcgatctgatagaagaaaaaaaaaccttcccttcaatgtaaaaccgaaactaacaagaaagaagcacagtgccgtttaggcaagtatggagtacgtattaagcatgtagaaggccatgcatgaaccactaacaagaaagaagcgcagtgccattcaggcaagcataagcatgtagattggcatgcatgaacaactaacagtagatcgtctctggtctgattagaagttttttgggaagccaagaaatcatgtacaactggttccatctcaaattccgtggcaaaaagaggcctaagcaacataaagctttccactggttgccatatatgatttgggcatttcactttgatcttaatgggccttgtaaagcccaagactcatgattatctttagttgatgctcttaattaggtgtgggcaaataattcaaactgtatgtacccgaccaaaaccaaagcaaaaataatcgaaccaaaccgaaaatttaaaaataaccgaatgaaaactaaatcctataactgaaagaactgaaaccgaatcaaaatatttaatgtaaccaaaaatatccgaaatataattatattgtcaaaaatattaataatttctagattaaataattaaaaatacttaaaaatttatataaaatagtaaaaatactcgaaaataaccacaaatattcaaaaacaaccgaaatatcccaaaatattcaaagcaaaataaccgaatggataccaaattttaaaaccgaaaaaactggaacaaaaccaaaatcgaaccaaaatttcaaaaatcgaataaatactaaactttagaacaaaaaaaaacgataaccgaatgtatacgaaccaaagccgaattagataaccgaacgtccaggactactcttaatctttccgccacttatgatttgggctattactttgtttataatgagccttttcaagctcaagttcatgattgtccgtgagatgagaaactgacttgttggattcgaaaccctagctagtattggttaatacttaatacataaatgacctgcattgacatcatcatccaagaaaataaaaattgtatgcttgagatatttagttttcctagctaggttttctttattttagtaccgaatctttaggtgtgccacgttaatttagacccattttttcatacttaccaactgagtctagtttaatcatgactataatcgtataaaatgattcagtcgacgtcattgcgaacgtatataaaatcatccaaattgacgtcattccaaagaggtaagcatgcttatctaagagtccgagcatactaaacaagacgacattttatttgcactccaaatcaaattttgtattgcctaaagaaaaacaatcaaactcaagtttcttaaaattaatttcattcaaactaatcactttcaatatctcacatattattcatgccatttctatttgtctaaacatgatttaaaaaaaaaagtaaaatacaaagattactatgcaaaaactctataaaaaaaaattcaaatttcttatttatttgtgacatcaaattttcaaaataatttttttaattatcggttgatccggtcagtcgataaaaacataaactttcagcgaccgttaaaactttcctactaccgatttagagaaaatcttagcttgaaacgtaattgtaacctgccttcatgcaagtcgcaagatatgtcatcctaagttgtatatgttttctcaaaagatgtatttacttgagaaaatacgtttcaacgttgatggacaaccaattaagaatcaagcacctttcgtaatcaatttaggcttatcgtctaaggtatactgatttacgacagttgactagacttataaggaacaaaataatagaatagtttctaaacacttcacctaatcatagagactaagatggtaattcgtaaacgacaaagcctagtgacactgtccattgtaaaattccacatcatattagtattaaacatatacatgtagtttcctgaacacatgtagtatcaaacacacttcgtggcttcttcctcgaaacctgcggccgctcattaattaagtcatctagttgaaggatcgctatcaactttgtatagaaaagttgggccgaattcgagctcggtacggccagaatggcccggaccgaagcttcctttatgtattgtgaattgcctcatgactctgttttacatcaggaccttgtcagactagttggcaacagtgtataaatgaaagcagcagtgtgcaggtgacttctaatattgaagtgctcaatcaaaatcatgaggaaggcaaccaaaatagtgaaggccaaattactcctattcgaagcattgtgtctgaagatgcagatactgaaagatcagaaagggaaataggtctgacccctcctgcaggaccgtcagcattgccggatgagcagcttaacacgaaggtggagtgccacgaagctgaacgcaactgttgctatgatgaggacacttcgagcttatttgatactgaatcgctgtacagcaaagcatccagtttgcacgaagacactcgtaaggatacttctccaagtgatctatctgctccgagatctcccgaggaatctacagtttttctgaactcttctgttccgggatcagtaggtatcattgctgattctgattttgttcacgttgctctgacataatgtcttgttcaatcttttattgtagtatctgtgagagcctcctgactacatctttcattttgctttttcattaggaatctgtcgaagcagcaggagaagaggtatagacgaactccgcgccaagctgcagagtttcaaagtctccagcactgtaaaaggaagctacattgctatgagtgcccctcgcccgaagcaaggtgacaatctgagccaatctgcaatcgcgttgctccggaacagcgagaacgcacctgctgttaaagtaggccatcctggcaagccggaccctgatcttccggtcgacaagcgctgcagcccatcagtggaagatcaagggatcactgataggcagtagggcgtacgccgtagtttattattgtggacagttagcgtttgtgctcaacattagttggtggtggtggtgttcaacctttggctgaaggttattaggtgtgcatctgaccggaaactatccgtgtgtttgcgcagcgtgtagtgacgaagctgctctgtgcatttgttattagcagttaacatattgtgggtgtggtggccgtggtggaaatgttaagcaactggcagccgtacagttggttaattggttatgcaggcgtttggttttggcttttttgtaatcctgttatcgtgaacagatccgttgtgccccgtgctgttattcgtacacgtgctcacttgtttaatctcttgcaatggcttacccatgtactgggtccagaagacaggcgaggagcatggctattcggaacagaagagccgcaggtcgtttggcgttccatgagcagacactgcagtgagtggatagcaatcaatagcgatgctctttggccttccatgaaacgcacgcactcatgtacgccgcccacaatccaagtcggtgtacccccgaatcgtcgatcatattaattccggccgcctagcgctgctatatatagagagacctcgcggcactccactcggatcctgcaaggctgcaacgcacacacttccggccgactcgatccgtccaagtcgcagcacctaggatccatggccactgtgaacaactggctcgctttctccctctccccgcaggagctgccgccctcccagacgacggactccacactcatctcggccgccaccgccgaccatgtctccggcgatgtctgcttcaacatcccccaagattggagcatgaggggatcagagctttcggcgctcgtcgcggagccgaagctggaggacttcctcggcggcatctccttctccgagcagcatcacaaggccaactgcaacatgatacccagcactagcagcacagtttgctacgcgagctcaggtgctagcaccggctaccatcaccagctgtaccaccagcccaccagctcagcgctccacttcgcggactccgtaatggtggcctcctcggccggtgtccacgacggcggtgccatgctcagcgcggccgccgctaacggtgtcgctggcgctgccagtgccaacggcggcggcatcgggctgtccatgattaagaactggctgcggagccaaccggcgcccatgcagccgagggtggcggcggctgagggcgcgcaggggctctctttgtccatgaacatggcggggacgacccaaggcgctgctggcatgccacttctcgctggagagcgcgcacgggcgcccgagagtgtatcgacgtcagcacagggtggagccgtcgtcgtcacggcgccgaaggaggatagcggtggcagcggtgttgccggcgctctagtagccgtgagcacggacacgggtggcagcggcggcgcgtcggctgacaacacggcaaggaagacggtggacacgttcgggcagcgcacgtcgatttaccgtggcgtgacaaggcatagatggactgggagatatgaggcacatctttgggataacagttgcagaagggaagggcaaactcgtaagggtcgtcaagtctatttaggtggctatgataaagaggagaaagctgctagggcttatgatcttgctgctctgaagtactggggtgccacaacaacaacaaattttccagtgagtaactacgaaaaggagctcgaggacatgaagcacatgacaaggcaggagtttgtagcgtctctgagaaggaagagcagtggtttctccagaggtgcatccatttacaggggagtgactaggcatcaccaacatggaagatggcaagcacggattggacgagttgcagggaacaaggatctttacttgggcaccttcagcacccaggaggaggcagcggaggcgtacgacatcgcggcgatcaagttccgcggcctcaacgccgtcaccaacttcgacatgagccgctacgacgtgaagagcatcctggacagcagcgccctccccatcggcagcgccgccaagcgcctcaaggaggccgaggccgcagcgtccgcgcagcaccaccacgccggcgtggtgagctacgacgtcggccgcatcgcctcgcagctcggcgacggcggagccctggcggcggcgtacggcgcgcactaccacggcgccgcctggccgaccatcgcgttccagccgggcgccgccagcacaggcctgtaccacccgtacgcgcagcagccaatgcgcggcggcgggtggtgcaagcaggagcaggaccacgcggtgatcgcggccgcgcacagcctgcaggacctccaccacctgaacctgggcgcggccggcgcgcacgactttttctcggcagggcagcaggccgccgccgctgcgatgcacggcctgggtagcatcgacagtgcgtcgctcgagcacagcaccggctccaactccgtcgtctacaacggcggggtcggcgacagcaacggcgccagcgccgtcggcggcagtggcggtggctacatgatgccgatgagcgctgccggagcaaccactacatcggcaatggtgagccacgagcaggtgcatgcacgggcctacgacgaagccaagcaggctgctcagatggggtacgagagctacctggtgaacgcggagaacaatggtggcggaaggatgtctgcatgggggactgtcgtgtctgcagccgcggcggcagcagcaagcagcaacgacaacatggccgccgacgtcggccatggcggcgcgcagctcttcagtgtctggaacgacacttaaggtaccacatggttaacctagacttgtccatcttctggattggccaacttaattaatgtatgaaataaaaggatgcacacatagtgacatgctaatcactataatgtgggcatcaaagttgtgtgttatgtgtaattactagttatctgaataaaagagaaagagatcatccatatttcttatcctaaatgaatgtcacgtgtctttataattctttgatgaaccagatgcatttcattaaccaaatccatatacatataaatattaatcatatataattaatatcaattgggttagcaaaacaaatctagtctaggtgtgttttgcgaatgcggccgccaccgcggtggagctcgaattccggtccgggcctagaaggccagcttcaagtttgtacaaaaaagcaggctccggccagaatggcccggaccgggttaccgaattcgagctcggtaccctgggatccgatatcgatgggccctggccgaagcttggtcacccggtccgggcctagaaggccgatctcccgggcacccagctttcttgtacaaagtggccgttaacggatcggccagaatggcccggaccgggttaccgaattcgagctcggtaccctgggatccgatatcgatgggccctggccgaagcttggtcacccggtccgggcctagaaggccagcttcggccgccccgggcaactttattatacaaagttgatagatcctcatgtcttcatcgtaagcttaaacaggccagaatggcctctggattcagcggcctagaaggccgaagtacttggtcttcctagtcgagtagatcacattcaagcttggtcacccggtccgtcaatattctgattccgatgacttcgtaggttcctagctcaagccgctcgtgtccaagcgtcacttacgattagctaatgattacggcatctaggaccgactagtggcgcgccgactagctagctaaggtaccgagctcgaattcattccgattaatcgtggcctcttgctcttcaggatgaagagctatgtttaaacgtgcaagcgctactagacaattcagtacattaaaaacgtccgcaatgtgttattaagttgtctaagcgtcaatttgtttacaccacaatatatcctgcca

SEQ ID NO: 417 - DNA, 1323 bp, Ruminococcus sp.
ctggtcaaagtcgtaaaaatccatctaattagtgagcaatttgacaaagcaggcaaccggatagattatgaagaagtcaataaaatactgtgggaattgcaaaagcagacacgagaagcaaagaataaaactgttcagcttctttgggaatggaacaatttttcaagcgattatgttaaggcgagtggcatatatcctaaagcaaaagacatatttggctactcaagtgtgcatggacaagcaaacaaagaattaagaacaaaactcgctttaaattcaagtaatctttccactaccacaatggacgtatgtaaaaattttaatacatataaaaaagaggtatggaaaggcaaacgatcagttccttcgtacaaatcagaccaacctcttgatctgcacaaagactctataaagctgatatatgaaaacaacgaattttatgttaggctcgctttattaaaaaaagctgaatttgcaaagtatggttttaaagacggttttcgttttaaaatgcaggtgaaagataattctaccaaaactattcttgaacgctgttttgacgaagtatacaaaataaatgccagcaaacttttatatgaccaaaagaaaaagaagtggaagcttaatctgtcttatagtttcgacaataaaaacatttctgaacttgacaaagaaaagatccttggtgttgatgtaggcgttaactgtcctttagtcgcttcggttttcggcgatcgtgaccgattcataatcaagggcggcgaaattgaaaaattcagaaaaagcgtggaagctcgcagacgttcaatgctcgagcaaacaaaatactgcggtgacggaagaattggtcacggcagaaaaaaacgcactgagcctgccctaaatataggcgacaagatagcaagatttcgtgatacaacaaaccacaaatacagcagagctttgatagaatatgctgtaaaaaagggctgcggaactatccaaatggaaaagctgacgggtattacatctaaatctgatcgttttctaaaagactggacttattatgacctccagacaaagatagaaaacaaggcgaaagaagtagggataaatgtcgtctatatcgcccctaaatatacaagtcagagatgtagcaaatgcggatatatccacaaggataacagaccaaatcaggcgaaatttagatgtcttgaatgcgattttgaaagtaatgcagattataatgcaagtcagaatatcggaattaaaaacattgataagataatagaaaaagatttgcaaaagcaagaaagcgaagtccaagtgaacgaaaacaagtag

SEQ ID NO: 418 - DNA, 1494 bp, Syntrophomonas palmitatica
atgggcgaatcggtaaaagcaataaaattaaagatactggatatgtttttagaccccgaatgcacaaagcaggatgataactggcgcaaagatttgtctactatgtccagattctgcgctgaagcggggaatatgtgtctgcgcgacctgtataattacttttcaatgcccaaggaagaccgtatttcctcaaaagacttatataacgctatgtatcataaaactaaacttctccatcctgaattaccaggtaaggtagcgaaccaaatagtaaaccacgctaaagatgtttggaaacgcaacgctaaactcatttatcggaaccaaatctcaatgcctacatataagataacaacagcaccaatccggctgcaaaataacatttataaattaataaaaaataagaacaaatacataatagacgtacagttatactccaaggaatactccaaggatagtggtaaaggcactcataggtattttctggtagcagttagagactcatcaacccgtatgatattcgaccgtattatgagtaaggaccatattgacagtagtaaatcatacacgcaaggacaactccaaatcaagaaagaccaccaggggaaatggtattgcatcataccctatacattccctacacatgagacagtcctcgaccctgataaagtcatgggagtagaccttggcgttgcaaaagctgtttactgggcgtttaatagttcttataaaagaggctgtatcgacggtggggaaatagaacatttccgcaaaatgatacgagctcgcagggtgtccatccaaaatcaaatcaaacattcaggggacgcccgtaaaggacatgggcgcaaaagggcgttaaaacccatagaaacattgagcgagaaggaaaagaattttagggatacaataaaccaccgctatgcaaatcgaattgtagaagctgctattaagcaaggctgtgggacaatccaaatcgaaaaccttgaaggtatagctgacacaacaggcagtaaatttctcaagaactggccttattacgacctgcagacaaaaattgttaataaagccaaggaacatggcattaccgttgttgcaataaacccccaatatacatcccaaaggtgttcgatgtgcgggtatattgaaaaaaccaaccgttcatcacaggcagtatttgaatgtaaacaatgcggttacggcagtaggactatatgtattaactgcaggcacgtccaagtatccggggatgtttgtgaggaatgtggcggcatagtaaaaaaagaaaacgtaaacgcagactacaatgcggcaaaaaacatatccacaccgtacatcgaccagataataatggagaagtgtttagaactaggtattccttaccgcagtataacctgtaaagaatgtggtcacatacaggcttcaggaaatacctgcgaggtttgcggaagtactaatattttgaaaccaaagaaaattagaaaagcaaaataa

SEQ ID NO: 419 - DNA, 1494 bp, Clostridium novyi
atgattacagttagaaaaataaagttaacaataatgggagataaagatacaagaaatagtcaatacaaatggattagagatgaacaatacaatcagtacagagctttaaatatgggtatgacttatttagctgtaaatgatattttatatatgaatgaaagcggattagaaattcgaactattaaagatttaaaagattgtgaaaaagatattgataaaaataaaaaagaaattgaaaagttaactgcaagactagagaaggaacaaaataagaaaaattcctcatcagaaaaattagatgagattaaatataaaataagtttagtagaaaataaaattgaagattataaattaaaaatagttgagttaaataaaattcttgaagaaacacaaaaagaaagaatggatatacagaaagaatttaaagaaaaatatgtagatgatctttatcaagttttagataaaataccctttaagcatttagacaataaaagtctagttactcaaagaataaaagctgatataaagtcagataaaagtaatggactattaaaaggtgaaagaagtattagaaactacaagagaaactttcctttaatgactagaggacgagatttaaaatttaaatatgatgataatgatgatattgaaataaagtggatggaaggaattaaatttaaagttattttgggaaatagaataaaaaattccttagagcttagacacactttacataaagttatagagggaaaatataaaatatgtgatagtagtttgcaatttgataaaaataataatcttatacttaatttaactctagacattcctattgatattgtaaataaaaaagtttcaggaagagttgtaggagtagatttaggattaaagataccagcatattgtgcattaaatgatgttgaatatattaaaaaatctataggacgtatagatgatttcttgaaagttagaactcaaatgcagagtagaagaagaagacttcaaattgcaatacaaagtgctaaaggtggaaaaggtagggtgaataaacttcaagccttggagagatttgctgaaaaggagaagaattttgcaaagacatataatcattttttaagttctaatatagttaaatttgcagttagcaatcaggccgaacaaattaatatggagttattaagtttaaaagaaactcaaaataagtcaatactaagaaattggagttattatcaacttcaaacaatgattgagtataaagcccaacgtgaagggattaaagttaagtacatagatccttatcatacatcacaaacatgtagtaaatgtggtaattatgaagaaggacaaagagaatctcaagctgattttatatgcaaaaaatgtggttataaagttaatgctgattataatgcagctagaaatatcgctatgagtaataaatatataacaaaaaaagaagaaagtaagtattacaaaattaaagaaagtatggtataa

SEQ ID NO: 420 - protein, 440 aa, Ruminococcus sp
MVKVVKIHLISEQFDKAGNRIDYEEVNKILWELQKQTREAKNKTVQLLWEWNNFSSDYVKASGIYPKAKDIFGYSSVHGQANKELRTKLALNSSNLSTTTMDVCKNFNTYKKEVWKGKRSVPSYKSDQPLDLHKDSIKLIYENNEFYVRLALLKKAEFAKYGFKDGFRFKMQVKDNSTKTILERCFDEVYKINASKLLYDQKKKKWKLNLSYSFDNKNISELDKEKILGVDVGVNCPLVASVFGDRDRFIIKGGEIEKFRKSVEARRRSMLEQTKYCGDGRIGHGRKKRTEPALNIGDKIARFRDTTNHKYSRALIEYAVKKGCGTIQMEKLTGITSKSDRFLKDWTYYDLQTKIENKAKEVGINVVYIAPKYTSQRCSKCGYIHKDNRPNQAKFRCLECDFESNADYNASQNIGIKNIDKIIEKDLQKQESEVQVNENK

SEQ ID NO: 421 - protein, 497 aa, Syntrophomonas palmitatica
MGESVKAIKLKILDMFLDPECTKQDDNWRKDLSTMSRFCAEAGNMCLRDLYNYFSMPKEDRISSKDLYNAMYHKTKLLHPELPGKVANQIVNHAKDVWKRNAKLIYRNQISMPTYKITTAPIRLQNNIYKLIKNKNKYIIDVQLYSKEYSKDSGKGTHRYFLVAVRDSSTRMIFDRIMSKDHIDSSKSYTQGQLQIKKDHQGKWYCIIPYTFPTHETVLDPDKVMGVDLGVAKAVYWAFNSSYKRGCIDGGEIEHFRKMIRARRVSIQNQIKHSGDARKGHGRKRALKPIETLSEKEKNFRDTINHRYANRIVEAAIKQGCGTIQIENLEGIADTTGSKFLKNWPYYDLQTKIVNKAKEHGITVVAINPQYTSQRCSMCGYIEKTNRSSQAVFECKQCGYGSRTICINCRHVQVSGDVCEECGGIVKKENVNADYNAAKNISTPYIDQIIMEKCLELGIPYRSITCKECGHIQASGNTCEVCGSTNILKPKKIRKAK

SEQ ID NO: 422 - protein, 497 aa, Clostridium novyi
MITVRKIKLTIMGDKDTRNSQYKWIRDEQYNQYRALNMGMTYLAVNDILYMNESGLEIRTIKDLKDCEKDIDKNKKEIEKLTARLEKEQNKKNSSSEKLDEIKYKISLVENKIEDYKLKIVELNKILEETQKERMDIQKEFKEKYVDDLYQVLDKIPFKHLDNKSLVTQRIKADIKSDKSNGLLKGERSIRNYKRNFPLMTRGRDLKFKYDDNDDIEIKWMEGIKFKVILGNRIKNSLELRHTLHKVIEGKYKICDSSLQFDKNNNLILNLTLDIPIDIVNKKVSGRVVGVDLGLKIPAYCALNDVEYIKKSIGRIDDFLKVRTQMQSRRRRLQIAIQSAKGGKGRVNKLQALERFAEKEKNFAKTYNHFLSSNIVKFAVSNQAEQINMELLSLKETQNKSILRNWSYYQLQTMIEYKAQREGIKVKYIDPYHTSQTCSKCGNYEEGQRESQADFICKKCGYKVNADYNAARNIAMSNKYITKKEESKYYKIKESMV

SEQ ID NO: 423 - DNA, 10 bp, Artificial Sequence
  tubulin conserved site
sagggtgsag

That which is claimed:

1. A method of obtaining genome-modified, doubled haploid plant progeny, the method comprising:
   (a) obtaining a first plant transformed with one or more expression cassettes comprising:
      (i) a polynucleotide sequence encoding a morphogenic developmental polypeptide, wherein the morphogenic developmental polypeptide is a WUS/WOX homeobox polypeptide, a Babyboom (BBM) polypeptide or an Ovule Development Protein 2 (ODP2) polypeptide, or a LEC1 polypeptide;
      (ii) a polynucleotide sequence encoding an embryogenesis factor, wherein the embryogenesis factor is a maize cyclin delta-2 polypeptide comprising an amino acid sequence at least 95% identical to SEQ ID NO: 21; and
      (iii) a polynucleotide sequence encoding a Cas polypeptide, wherein the Cas polypeptide enables genomic modification of a DNA target site in the first plant, wherein at least one guide RNA is provided for the Cas polypeptide, the guide RNA comprising a region complementary to the DNA target site;
      wherein the Cas polypeptide and the guide RNA form a complex that binds and modifies the DNA target site resulting in a modified target site;
   (b) obtaining a second plant;
   (c) pollinating the first plant with pollen from the second plant;
   (d) obtaining embryogenic haploid progeny, wherein the haploid progeny comprises the genome of the first plant but not the second plant, and wherein the maize cyclin delta-2 polypeptide stimulates an embryogenic cell fate resulting in the embryogenic haploid progeny;
   (e) obtaining doubled haploid progeny from the haploid progeny, wherein the maize cyclin delta-2 polypeptide stimulates diploidization of the haploid progeny, resulting in the doubled haploid progeny; and
   (f) selecting genome-modified, doubled haploid plant progeny,
   wherein the maize cyclin delta-2 polypeptide increases the frequency of embryogenic cell fate and diploidization in the haploid progeny relative to a non-treated control.

2. The method of claim 1, wherein the Cas polypeptide is a Cas9 nuclease, a Cas alpha nuclease, a Cpf1 nuclease, a dCas9-FokI, a dCpf1-FokI, a chimeric Cas9-cytidine deaminase, a chimeric Cas9 adenine deaminase, a nickase Cas9 (nCas9), a chimeric dCas9 non-FokI nuclease, or a dCpf1-non-FokI nuclease.

3. The method of claim 1, wherein the second plant comprises a marker gene selected from the group comprising of GUS, PMI, PAT, GFP, RFP, CFP, C1, CRC, R-nj, R1-scm, and anthocyanin pigments.

4. The method of claim 1, further comprising regenerating a plant from the doubled haploid progeny.

5. The method of claim 1, wherein the polynucleotide sequence encoding the maize cyclin delta-2 polypeptide is stably incorporated into the genome of the first plant.

6. The method of claim 1, wherein the maize cyclin delta-2 polypeptide of the first plant stimulates reprogramming in egg cells promoting the embryogenic cell fate in the egg cells.

7. The method of claim 6, wherein the maize cyclin delta-2 polypeptide of the first plant stimulates maternal haploid induction and renders egg cells to become parthenogenic egg cells having only the maternal genome.

8. The method of claim 1, wherein the polynucleotide sequence encoding the maize cyclin delta-2 polypeptide is operably linked to an egg cell promoter.

9. The method of claim 1, wherein the one or more expression cassettes further comprise an excision component for excision of the one or more polynucleotide sequences encoding the one or more morphogenic developmental polypeptides and/or the polynucleotide sequence encoding the Cas polypeptide.

* * * * *